United States Patent
Huang

(10) Patent No.: US 10,876,121 B2
(45) Date of Patent: Dec. 29, 2020

(54) EGFR NUCLEIC ACIDS AND USES THEREOF

(71) Applicant: AVIDITY BIOSCIENCES, INC., La Jolla, CA (US)

(72) Inventor: Hanhua Huang, San Diego, CA (US)

(73) Assignee: AVIDITY BIOSCIENCES, INC., La Jolla, CA (US)

( * ) Notice: Subject to any disclaimer, the term of this patent is extended or adjusted under 35 U.S.C. 154(b) by 0 days.

(21) Appl. No.: 15/476,117

(22) Filed: Mar. 31, 2017

(65) Prior Publication Data

US 2017/0362597 A1   Dec. 21, 2017

Related U.S. Application Data

(60) Provisional application No. 62/317,105, filed on Apr. 1, 2016.

(51) Int. Cl.
   *C12N 15/113*   (2010.01)
   *A61K 31/7125*  (2006.01)

(52) U.S. Cl.
   CPC ...... *C12N 15/1138* (2013.01); *A61K 31/7125* (2013.01); *C12N 2310/14* (2013.01); *C12N 2310/313* (2013.01); *C12N 2310/315* (2013.01); *C12N 2310/321* (2013.01); *C12N 2310/322* (2013.01); *C12N 2310/3231* (2013.01)

(58) Field of Classification Search
   CPC ............ C12N 15/1138; C12N 2310/14; C12N 2310/313; C12N 2310/315; C12N 2310/321; C12N 2310/322; C12N 2310/3231; C12N 2310/317; C12N 2310/343; A61K 31/7125
   See application file for complete search history.

(56) References Cited

U.S. PATENT DOCUMENTS

| | | | |
|---|---|---|---|
| 5,142,047 A | 8/1992 | Summerton et al. |
| 5,185,444 A | 2/1993 | Summerton et al. |
| 5,334,711 A | 8/1994 | Sproat et al. |
| 5,627,053 A | 5/1997 | Usman et al. |
| 5,716,824 A | 2/1998 | Beigelman et al. |
| 5,889,136 A | 3/1999 | Scaringe et al. |
| 5,898,031 A | 4/1999 | Crooke |
| 6,008,400 A | 12/1999 | Scaringe et al. |
| 6,107,094 A | 8/2000 | Crooke |
| 6,111,086 A | 8/2000 | Scaringe |
| 7,056,704 B2 | 6/2006 | Tuschl et al. |
| 7,078,196 B2 | 7/2006 | Tuschl et al. |
| 7,432,249 B2 | 10/2008 | Crooke |
| 7,432,250 B2 | 10/2008 | Crooke |
| 7,459,547 B2 | 12/2008 | Zamore et al. |
| 7,629,321 B2 | 12/2009 | Crooke |
| 7,732,593 B2 | 6/2010 | Zamore et al. |
| 7,750,144 B2 | 7/2010 | Zamore et al. |
| 7,772,203 B2 | 8/2010 | Zamore et al. |
| 7,786,290 B2 | 8/2010 | Woppmann et al. |
| 7,829,693 B2 | 11/2010 | Kreutzer et al. |
| 7,850,975 B2 | 12/2010 | Mullis |
| 7,928,217 B2 | 4/2011 | Vornlocher et al. |
| 8,202,979 B2 | 6/2012 | McSwiggen et al. |
| 8,268,986 B2 | 9/2012 | Beigelman et al. |
| 8,273,866 B2 | 9/2012 | McSwiggen et al. |
| 8,283,329 B2 | 10/2012 | Fire et al. |
| 8,304,530 B2 | 11/2012 | Zamore et al. |
| 8,309,704 B2 | 11/2012 | Zamore et al. |
| 8,309,705 B2 | 11/2012 | Zamore et al. |
| 8,329,892 B2 | 12/2012 | Zamore et al. |
| 8,334,373 B2 | 12/2012 | Vornlocher et al. |
| 8,362,231 B2 | 1/2013 | Tuschl et al. |
| 8,372,968 B2 | 2/2013 | Tuschl et al. |
| 8,420,391 B2 | 4/2013 | Tuschl et al. |
| 8,445,237 B2 | 5/2013 | Tuschl et al. |
| 8,546,143 B2 | 10/2013 | Kreutzer et al. |
| 8,552,171 B2 | 10/2013 | Tuschl et al. |
| 8,591,910 B2 | 11/2013 | Mullis |
| 8,604,184 B2 | 12/2013 | Mullis et al. |
| 8,632,997 B2 | 1/2014 | Tuschl et al. |
| 8,648,185 B2 | 2/2014 | McSwigen et al. |
| 8,691,786 B2 | 4/2014 | Rossi et al. |
| 8,765,930 B2 | 7/2014 | Tuschl et al. |
| 8,772,469 B2 | 7/2014 | Uhlmann et al. |
| 8,778,902 B2 | 7/2014 | Tuschl et al. |
| 8,790,922 B2 | 7/2014 | Tuschl et al. |

(Continued)

FOREIGN PATENT DOCUMENTS

| EP | 1144623 B1 | 8/2002 |
|---|---|---|
| EP | 0928290 B1 | 3/2005 |

(Continued)

OTHER PUBLICATIONS

Abramova et al. Novel oligonucleotide analogues based on morpholino nucleoside subunits-antisense technologies: new chemical possibilities. Indian Journal of Chemistry 48B:1721-1726 (2009).

Beigelman et al. Chemical modification of hammerhead ribozymes. Catalytic activity and nuclease resistance. J Biol Chem 270:25702-25708 (1995).

Bell et al. Epidermal Growth Factor Receptor Mutations and Gene Amplification in Non-Small-Cell Lung Cancer: Molecular Analysis of the IDEAL/INTACT Gefitinib Trials. J Clin Oncol 23(31):8081-8092 (2005).

Burlina et al. Chemical engineering of RNase resistant and catalytically active hammerhead ribozymes. Bioorg Med Chem 5:1999-2010 (1997).

(Continued)

*Primary Examiner* — J. E. Angell
(74) *Attorney, Agent, or Firm* — Wilson Sonsini Goodrich & Rosati

(57) ABSTRACT

Disclosed herein are molecules and pharmaceutical compositions that mediate RNA interference against EGFR. Also described herein include methods for treating a disease or disorder that comprises a molecule or a pharmaceutical composition that mediate RNA interference against EGFR.

30 Claims, No Drawings

Specification includes a Sequence Listing.

(56) References Cited

U.S. PATENT DOCUMENTS

| | | | |
|---|---|---|---|
| 8,796,016 | B2 | 8/2014 | Tuschl et al. |
| 8,796,443 | B2 | 8/2014 | Khvorova et al. |
| 8,846,894 | B2 | 9/2014 | McSwiggen et al. |
| 8,853,384 | B2 | 10/2014 | Tuschl et al. |
| 8,895,718 | B2 | 11/2014 | Tuschl et al. |
| 8,895,721 | B2 | 11/2014 | Tuschl et al. |
| 8,933,044 | B2 | 1/2015 | Tuschl et al. |
| 8,993,745 | B2 | 3/2015 | Tuschl et al. |
| 9,012,138 | B2 | 4/2015 | Tuschl et al. |
| 9,012,621 | B2 | 4/2015 | Tuschl et al. |
| 9,096,636 | B2 | 8/2015 | Baker et al. |
| 9,175,289 | B2 | 11/2015 | Khvorova et al. |
| 9,193,753 | B2 | 11/2015 | Tuschl et al. |
| 9,212,364 | B2 | 12/2015 | Sah et al. |
| 9,284,551 | B2 | 3/2016 | Puri et al. |
| 2002/0142980 | A1 | 10/2002 | Thompson et al. |
| 2005/0080246 | A1* | 4/2005 | Allerson ............... C12N 15/111 536/23.1 |
| 2005/0176018 | A1 | 8/2005 | Thompson et al. |
| 2011/0039914 | A1 | 2/2011 | Pavco et al. |
| 2011/0046067 | A1 | 2/2011 | Yang et al. |
| 2011/0263680 | A1 | 10/2011 | Khvorova et al. |
| 2013/0045520 | A1 | 2/2013 | Woolf et al. |
| 2013/0164366 | A1 | 6/2013 | Kreutzer et al. |
| 2013/0177631 | A1 | 7/2013 | Kreutzer et al. |
| 2014/0155462 | A1 | 6/2014 | Brown et al. |
| 2014/0194610 | A1 | 7/2014 | Verdine et al. |
| 2014/0288158 | A1 | 9/2014 | Rajeev et al. |
| 2014/0357700 | A1 | 12/2014 | Rossi et al. |
| 2015/0038554 | A1 | 2/2015 | Brown |
| 2015/0038555 | A1 | 2/2015 | Brown |
| 2015/0141492 | A1 | 5/2015 | Tuschl et al. |
| 2015/0211006 | A1 | 7/2015 | Butler et al. |
| 2016/0030332 | A1 | 2/2016 | Lee et al. |
| 2016/0032288 | A1 | 2/2016 | Tuschl et al. |

FOREIGN PATENT DOCUMENTS

| | | |
|---|---|---|
| EP | 1214945 B1 | 6/2005 |
| EP | 1579015 A2 | 9/2005 |
| EP | 1352061 B1 | 5/2006 |
| EP | 1742958 A2 | 1/2007 |
| EP | 1407044 B1 | 9/2007 |
| EP | 1550719 B1 | 12/2008 |
| EP | 1349927 B1 | 3/2010 |
| EP | 1409670 B1 | 10/2010 |
| EP | 1633890 B1 | 10/2010 |
| EP | 2336317 A1 | 6/2011 |
| EP | 2361923 A2 | 8/2011 |
| EP | 1873259 B1 | 1/2012 |
| EP | 2514758 A1 | 10/2012 |
| EP | 2351852 B1 | 10/2013 |
| EP | 2195428 B1 | 12/2013 |
| EP | 2028278 B1 | 3/2014 |
| EP | 2348133 B1 | 7/2014 |
| EP | 1633770 B1 | 4/2015 |
| EP | 2340310 B1 | 6/2015 |
| EP | 2949752 A2 | 12/2015 |
| EP | 2548962 B1 | 1/2016 |
| EP | 2813582 B1 | 4/2017 |
| WO | WO-9207065 A1 | 4/1992 |
| WO | WO-9315187 A1 | 8/1993 |
| WO | WO-9726270 A2 | 7/1997 |
| WO | WO-9813526 A1 | 4/1998 |
| WO | WO-03070912 A2 | 8/2003 |
| WO | WO-03074654 A2 | 9/2003 |
| WO | WO-2009002440 A2 | 12/2008 |
| WO | WO-2009099942 A2 | 8/2009 |
| WO | WO-2014154835 A2 | 10/2014 |
| WO | WO-2015107425 A2 | 7/2015 |
| WO | WO-2015200223 A1 | 12/2015 |
| WO | WO-2016028649 A1 | 2/2016 |
| WO | WO-2017173301 A1 | 10/2017 |

OTHER PUBLICATIONS

Earnshaw et al. Modified oligoribonucleotides as site-specific probes of RNA structure and function. Biopolymers (Nucleic Acid Sciences) 48:39-55 (1998).

Griffey et al. 2'-0-aminopropyl ribonucleotides: a zwitterionic modification that enhances the exonuclease resistance and biological activity of antisense oligonucleotides, J. Med. Chem. 39(26):5100-5109 (1997).

Karpeisky et al. Highly efficient synthesis of 2'-O-amino nucleosides and their incorporation in hammerhead ribozymes. Tetrahedron Lett 39:1131-1134 (1998).

Koizumi. ENA oligonucleotides as therapeutics. Curr Opin Mol Ther 8(2):144-149 (2006).

Loakes. Survey and summary: The applications of universal DNA base analogues. Nucleic Acids Research 29:2437-2447 (2001).

Martinez et al. Single-stranded antisense siRNAs guide target RNA cleavage in RNAi. Cell 110(5):563-574 (2002).

Obika et al. Synthesis of 2'-0,4'-C-methyleneuridine and -cytidine. Novel bicyclic nucleosides having a fixed C3'-endo sugar puckering. Tetrahedron Lett. 38(50):8735-8738 (1997).

Perrault et al. Mixed deoxyribo- and ribo-oligonucleotides with catalytic activity. Nature 344:565-568 (1990).

Pieken et al. Kinetic characterization of ribonuclease-resistant 2'-modified hammerhead ribozymes. Science 253:314-317 (1991).

Schwarz et al. Evidence that siRNAs function as guides, not primers, in the Drosophila and human RNAi pathways. Molecular Cell 10:537-548 (2002).

Singh et al. Recent developments in oligonucleotide conjugation. Chem Soc Rev 39(6):2054-2070 (2010).

Talasila et al. EGFR Wild-type Amplification and Activation Promote Invasion and Development of Glioblastoma Independent of Angiogenesis. Acta Neuropathol. 125(5):683-698 (2013).

Usman et al. Exploiting the chemical synthesis of RNA. Trends Biochem Sci 17:334-339 (1992).

Verma et al. Modified oligonucleotides: synthesis and strategy for users. Annu Rev Biochem 67:99-134 (1998).

Chiu et al. siRNA function in RNAi: A chemical modification analysis. RNA 9:1034-1048 (2003).

Deleavey et al. Designing chemically modified oligonucleotides for targeted gene silencing. Chem Biol. 19(8):937-954 (2012).

Jackson et al. Position-specific chemical modification of siRNAs reduces "off-target" transcript silencing. RNA 12:1197-1205 (2006).

PCT/US2017/025431 International Search Report and Written Opinion dated Jul. 10, 2017.

* cited by examiner

EGFR NUCLEIC ACIDS AND USES THEREOF

CROSS-REFERENCE

This application claims the benefit of U.S. Provisional Application No. 62/317,105, filed Apr. 1, 2016, which application is incorporated herein by reference.

SEQUENCE LISTING

The instant application contains a Sequence Listing which has been submitted electronically in ASCII format and is hereby incorporated by reference in its entirety. Said ASCII copy, created on Mar. 24, 2017, is named 45532-709_201_SL.txt and is 554,437 bytes in size.

BACKGROUND OF THE DISCLOSURE

Gene suppression by RNA-induced gene silencing provides several levels of control: transcription inactivation, small interfering RNA (siRNA)-induced mRNA degradation, and siRNA-induced transcriptional attenuation. In some instances, RNA interference (RNAi) provides long lasting effect over multiple cell divisions. As such, RNAi represents a viable method useful for drug target validation, gene function analysis, pathway analysis, and disease therapeutics.

SUMMARY OF THE DISCLOSURE

Disclosed herein, in certain embodiments, are molecules and pharmaceutical compositions for modulating EGFR function and/or expression in a cell.

Disclosed herein, in certain embodiments, is a polynucleic acid molecule that mediates RNA interference against EGFR, wherein the polynucleic acid molecule comprises at least one 2' modified nucleotide, at least one modified internucleotide linkage, or at least one inverted abasic moiety.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some embodiments, the at least one 2' modified nucleotide comprises locked nucleic acid (LNA) or ethylene nucleic acid (ENA). In some embodiments, the at least one inverted basic moiety is at at least one terminus. In some embodiments, the at least one modified internucleotide linkage comprises a phosphorothioate linkage or a phosphorodithioate linkage.

In some embodiments, the polynucleic acid molecule is at least from about 10 to about 30 nucleotides in length. In some embodiments, the polynucleic acid molecule is at least one of: from about 15 to about 30, from about 18 to about 25, form about 18 to about 24, from about 19 to about 23, or from about 20 to about 22 nucleotides in length. In some embodiments, the polynucleic acid molecule is at least about 16, 17, 18, 19, 20, 21, 22, 23, 24, or 25 nucleotides in length.

In some embodiments, the polynucleic acid molecule comprises at least one of: from about 5% to about 100% modification, from about 10% to about 100% modification, from about 20% to about 100% modification, from about 30% to about 100% modification, from about 40% to about 100% modification, from about 50% to about 100% modification, from about 60% to about 100% modification, from about 70% to about 100% modification, from about 80% to about 100% modification, and from about 90% to about 100% modification.

In some embodiments, the polynucleic acid molecule comprises at least one of: from about 10% to about 90% modification, from about 20% to about 90% modification, from about 30% to about 90% modification, from about 40% to about 90% modification, from about 50% to about 90% modification, from about 60% to about 90% modification, from about 70% to about 90% modification, and from about 80% to about 100% modification.

In some embodiments, the polynucleic acid molecule comprises at least one of: from about 10% to about 80% modification, from about 20% to about 80% modification, from about 30% to about 80% modification, from about 40% to about 80% modification, from about 50% to about 80% modification, from about 60% to about 80% modification, and from about 70% to about 80% modification.

In some embodiments, the polynucleic acid molecule comprises at least one of: from about 10% to about 70% modification, from about 20% to about 70% modification, from about 30% to about 70% modification, from about 40% to about 70% modification, from about 50% to about 70% modification, and from about 60% to about 70% modification.

In some embodiments, the polynucleic acid molecule comprises at least one of: from about 10% to about 60% modification, from about 20% to about 60% modification, from about 30% to about 60% modification, from about 40% to about 60% modification, and from about 50% to about 60% modification.

In some embodiments, the polynucleic acid molecule comprises at least one of: from about 10% to about 50% modification, from about 20% to about 50% modification, from about 30% to about 50% modification, and from about 40% to about 50% modification.

In some embodiments, the polynucleic acid molecule comprises at least one of: from about 10% to about 40% modification, from about 20% to about 40% modification, and from about 30% to about 40% modification.

In some embodiments, the polynucleic acid molecule comprises at least one of: from about 10% to about 30% modification, and from about 20% to about 30% modification.

In some embodiments, the polynucleic acid molecule comprises from about 10% to about 20% modification.

In some embodiments, the polynucleic acid molecule comprises from about 15% to about 90%, from about 20% to about 80%, from about 30% to about 70%, or from about 40% to about 60% modifications.

In some embodiments, the polynucleic acid molecule comprises at least about 15%, 20%, 30%, 40%, 50%, 60%, 70%, 80%, 90%, 95%, or 99% modification.

In some embodiments, the polynucleic acid molecule comprises at least about 3, about 4, about 5, about 6, about 7, about 8, about 9, about 10, about 11, about 12, about 13, about 14, about 15, about 16, about 17, about 18, about 19, about 20, about 21, about 22 or more modifications.

In some embodiments, the polynucleic acid molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22 or more modified nucleotides.

In some embodiments, the polynucleic acid molecule comprises a sequence that hybridizes to a target sequence selected from SEQ ID NOs: 1-376.

In some embodiments, the polynucleic acid molecule comprises a single strand.

In some embodiments, the polynucleic acid molecule comprises two or more strands.

In some embodiments, the polynucleic acid molecule comprises a first polynucleotide and a second polynucleotide hybridized to the first polynucleotide to form a double-stranded polynucleic acid molecule.

In some embodiments, the second polynucleotide comprises at least one modification.

In some embodiments, the first polynucleotide and the second polynucleotide are RNA molecules. In some embodiments, the first polynucleotide and the second polynucleotide are siRNA molecules.

In some embodiments, the first polynucleotide comprises a sequence having at least 60%, 65%, 70%, 75%, 80%, 85%, 90%, 95%, 96%, 97%, 98%, 99%, or 100% sequence identity to SEQ ID NOs: 377-1892. In some embodiments, the first polynucleotide consists of a sequence selected from SEQ ID NOs: 377-1892. In some embodiments, the second polynucleotide comprises a sequence having at least 60%, 65%, 70%, 75%, 80%, 85%, 90%, 95%, 96%, 97%, 98%, 99%, or 100% sequence identity to SEQ ID NOs: 377-1892. In some embodiments, the second polynucleotide consists of a sequence selected from SEQ ID NOs: 377-1892.

Disclosed herein, in certain embodiments, is a pharmaceutical composition comprising: a) a molecule disclosed above; and b) a pharmaceutically acceptable excipient. In some embodiments, the pharmaceutical composition is formulated as a nanoparticle formulation. In some embodiments, the pharmaceutical composition is formulated for parenteral, oral, intranasal, buccal, rectal, or transdermal administration.

Disclosed herein, in certain embodiments, is a method of treating a disease or disorder in a patient in need thereof, comprising administering to the patient a composition comprising a molecule disclosed above. In some embodiments, the disease or disorder is a cancer. In some embodiments, the cancer is a solid tumor. In some embodiments, the cancer is a hematologic malignancy. In some embodiments, the cancer comprises an EGFR-associated cancer. In some embodiments, the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, or thyroid cancer. In some embodiments, the cancer comprises acute myeloid leukemia, CLL, DLBCL, or multiple myeloma.

Disclosed herein, in certain embodiments, is a method of inhibiting the expression of a target gene in a primary cell of a patient, comprising administering a molecule disclosed above to the primary cell. In some embodiments, the method is an in vivo method. In some embodiments, the patient is a human.

Disclosed herein, in certain embodiments, is a kit comprising a molecule disclosed above.

DETAILED DESCRIPTION OF THE DISCLOSURE

Epidermal growth factor receptor (EGFR, ErbB-1, or HER1) is a transmembrane tyrosine kinase receptor and a member of the ErbB family of receptors, which also include HER2/c-neu (ErbB-2), Her3 (ErbB-3), and Her4 (ErbB-4).

In some instances, EGFR mutations drive the downstream activation of RAS/RAF/MAPK, PI3K/AKT, and/or JAK/STAT pathways, leading to mitosis, cell proliferation, and suppression of apoptosis. In addition, amplification of wild-type EGFR gene has been implicated in the development of cancers such as glioblastomas and non-small cell lung cancer (Talasila, et al., "EGFR Wild-type Amplification and Activation Promote Invasion and Development of Glioblastoma Independent of Angiogenesis," Acta Neuropathol. 125 (5): 683-698 (2013); Bell et al., "Epidermal Growth Factor Receptor Mutations and Gene Amplification in Non-Small-Cell Lung Cancer: Molecular Analysis of the IDEAL/INTACT Gefitinib Trials," J. Clinical Oncology 23(31): 8081-8092 (2005)).

Disclosed herein, in certain embodiments, are polynucleic acid molecules and pharmaceutical compositions that modulate the expression of EGFR. In some instances, the polynucleic acid molecules and pharmaceutical compositions modulate the expression of wild type EGFR gene. In other instances, the polynucleic acid molecules and pharmaceutical compositions modulate the expression of mutant EGFR.

In some embodiments, the polynucleic acid molecules and pharmaceutical compositions are used for the treatment of a disease or disorder (e.g., cancer or an EGFR-associated disease or disorder). In additional embodiments, the polynucleic acid molecules and pharmaceutical compositions are used for inhibiting the expression of EGFR gene in a primary cell of a patient in need thereof.

In additional cases, also included herein are kits that comprise one or more of polynucleic acid molecules and pharmaceutical compositions described herein.

Polynucleic Acid Molecule

In some embodiments, a polynucleic acid molecule described herein modulates the expression of the EGFR gene (GenBank: BC094761.1). In some embodiments, EGFR DNA or RNA is wild type EGFR or EGFR comprising a mutation. In some instances, EGFR is wild type EGFR. In some instances, EGFR DNA or RNA comprises a mutation. In some instances, the polynucleic acid molecule hybridizes to a target region of wild type EGFR DNA or RNA. In some instances, the polynucleic acid molecule hybridizes to a target region of EGFR DNA or RNA comprising a mutation (e.g., a substitution, a deletion, or an addition).

In some instances, EGFR DNA or RNA comprises one or more mutations. In some embodiments, EGFR DNA or RNA comprises one or more mutations within one or more exons. In some instances, the one or more exons comprise exon 18, exon 19, exon 20, exon 21, or exon 22. In some instances, EGFR DNA or RNA comprises one or more mutations in exon 18, exon 19, exon 20, exon 21, exon 22, or a combination thereof.

In some instances, EGFR DNA or RNA comprises one or more mutations at positions corresponding to amino acid residues 34, 38, 45, 62, 63, 77, 78, 108, 114, 120, 140, 148, 149, 160, 177, 178, 189, 191, 198, 220, 222, 223, 229, 237, 240, 244, 252, 254, 255, 256, 263, 270, 273, 276, 282, 288, 289, 301, 303, 304, 309, 314, 326, 331, 354, 363, 373, 337, 380, 384, 393, 427, 428, 437, 441, 447, 465, 475, 515, 526, 527, 531, 536, 541, 546, 571, 588, 589, 596, 596, 598, 602, 614, 620, 628, 636, 641, 645, 651, 671, 689, 694, 700, 709, 712, 714, 715, 716, 719, 720, 721, 731, 733, 739-744, 742, 746-750, 746-752, 746, 747, 747-749, 747-751, 747-753, 751, 752, 754, 752-759, 750, 761-762, 761, 763, 765, 767-768, 767-769, 768, 769, 769-770, 770-771, 772, 773-774, 773, 774, 774-775, 776, 779, 783, 784, 786, 790, 792, 794, 798, 803, 805, 807, 810, 826, 827, 831, 832, 833, 835, 837, 838, 839, 842, 843, 847, 850, 851, 853, 854, 856, 858, 861, 863, 894, 917, 967, 1006, 1019, 1042, 1100, 1129, 1141, 1153, 1164, 1167, or a combination thereof of the EGFR polypeptide. In some embodiments, EGFR DNA or RNA comprises one or more mutations at positions corresponding to amino acid residues 747, 761, 790, 854, 858, or a combination thereof of the EGFR polypeptide. In some embodiments, EGFR DNA or RNA comprises one or more mutations at positions corresponding to amino acid residues 761, 790, 858, or a combination thereof of the EGFR polypeptide. In some embodiments, EGFR DNA or RNA comprises a mutation at a position corresponding to amino acid residue 747 of the EGFR polypeptide. In some embodiments, EGFR DNA or RNA comprises a mutation at a position corresponding to amino acid residue 761 of the EGFR polypeptide. In some embodiments, EGFR DNA or RNA comprises a mutation at a position corresponding to amino acid residue 790 of the EGFR polypeptide. In some embodiments, EGFR DNA or RNA comprises a mutation at a position corresponding to amino acid residue 854 of the EGFR polypeptide. In some embodiments, EGFR DNA or RNA comprises a mutation at a position corresponding to amino acid residue 858 of the EGFR polypeptide.

In some embodiments, EGFR DNA or RNA comprises one or more mutations selected from T34M, L38V, E45Q, L62R, G63R, G63K, S77F, F78L, R108K, R108G, E114K, A120P, L140V, V148M, R149W, E160K, S177P, M178I, K189T, D191N, S198R, S220P, R222L, R222C, S223Y, S229C, A237Y, C240Y, R244G, R252C, R252P, F254I, R255 (nonsense mutation), D256Y, T263P, Y270C, T273A, Q276 (nonsense), E282K, G288 (frame shift), A289D, A289V, A289T, A289N, A289D, V301 (deletion), D303H, H304Y, R309Q, D314N, C326R, G331R, T354M, T363I, P373Q, R337S, S380 (frame shift), T384S, D393Y, R427L, G428S, S437Y, V441I, S447Y, G465R, I475V, C515S, C526S, R527L, R531 (nonsense), V536M, L541I, P546Q, C571S, G588S, P589L, P596L, P596S, P596R, P596L, G598V, G598A, E602G, G614D, C620Y, C620W, C628Y, C628F, C636Y, T638M, P641H, S645C, V651M, R671C, V689M, P694S, N700D, E709A, E709K, E709Q, E709K, F712L, K714N, I715S, K716R, G719A, G719C, G719D, G719S, S720C, S720F, G721V, W731Stop, P733L, K739-I744 (insertion), V742I, V742A, E746-A750 (deletion), E746K, L747S, L747-E749 (deletion), L747-T751 (deletion), L747-P753 (deletion), G746-S752 (deletion), T751I, S752Y, K754 (deletion), S752-I759 (deletion), A750P, D761-E762 (e.g., residues EAFQ (SEQ ID NO: 1893) insertion), D761N, D761Y, A763V, V765A, A767-S768 (e.g., residues TLA insertion), A767-V769 (e.g., residues ASV insertion), S768I, S768T, V769L, V769M, V769-D770 (e.g., residue Y insertion), 770-771 (e.g., residues GL insertion), 770-771 (e.g., residue G insertion), 770-771 (e.g., residues CV insertion), 770-771 (e.g., residues SVD insertion), P772R, 773-774 (e.g., residues NPH insertion), H773R, H773L, V774M, 774-775 (e.g., residues HV insertion), R776H, R776C, G779F, T783A, T784F, T854A, V786L, T790M, L792P, P794H, L798F, R803W, H805R, D807H, G810S, N826S, Y827 (nonsense), R831H, R832C, R832H, L833F, L833V, H835L, D837V, L838M, L838P, A839V, N842H, V843L, T847K, T847I, H850N, V851A, I853T, F856L, L858R, L858M, L861Q, L861R, G863D, Q894L, G917A, E967A, D1006Y, P1019L, S1042N, R1100S, H1129Y, T1141S, S1153I, Q1164R, L1167M, or a combination thereof of the EGFR polypeptide.

In some instances, the polynucleic acid molecule hybridizes to a target region of EGFR DNA or RNA comprising one or more mutations. In some embodiments, the polynucleic acid molecule hybridizes to a target region of EGFR DNA or RNA comprising one or more mutations in exon 18, exon 19, exon 20, exon 21, exon 22, or a combination thereof.

In some embodiments, a polynucleic acid molecule hybridizes to a target region of EGFR DNA or RNA comprising one or more mutations at positions corresponding to amino acid residues 34, 38, 45, 62, 63, 77, 78, 108, 114, 120, 140, 148, 149, 160, 177, 178, 189, 191, 198, 220, 222, 223, 229, 237, 240, 244, 252, 254, 255, 256, 263, 270, 273, 276, 282, 288, 289, 301, 303, 304, 309, 314, 326, 331, 354, 363, 373, 337, 380, 384, 393, 427, 428, 437, 441, 447, 465, 475, 515, 526, 527, 531, 536, 541, 546, 571, 588, 589, 596, 596, 598, 602, 614, 620, 628, 636, 641, 645, 651, 671, 689, 694, 700, 709, 712, 714, 715, 716, 719, 720, 721, 731, 733, 739-744, 742, 746-750, 746-752, 746, 747, 747-749, 747-751, 747-753, 751, 752, 754, 752-759, 750, 761-762, 761, 763, 765, 767-768, 767-769, 768, 769, 769-770, 770-771, 772, 773-774, 773, 774, 774-775, 776, 779, 783, 784, 786, 790, 792, 794, 798, 803, 805, 807, 810, 826, 827, 831, 832, 833, 835, 837, 838, 839, 842, 843, 847, 850, 851, 853, 854, 856, 858, 861, 863, 894, 917, 967, 1006, 1019, 1042, 1100, 1129, 1141, 1153, 1164, 1167, or a combination thereof of the EGFR polypeptide. In some embodiments, the polynucleic acid molecule hybridizes to a target region of EGFR DNA or RNA comprising one or more mutations at positions corresponding to amino acid residues 747, 761, 790, 854, 858, or a combination thereof of the EGFR polypeptide. In some embodiments, the polynucleic acid molecule hybridizes to a target region of EGFR DNA or RNA comprising one or more mutations at positions corresponding to amino acid residues 761, 790, 858, or a combination thereof of the EGFR polypeptide. In some embodiments, the polynucleic acid molecule hybridizes to a target region of EGFR DNA or RNA comprising a mutation at a position corresponding to amino acid residue 747 of the EGFR polypeptide. In some embodiments, the polynucleic acid molecule hybridizes to a target region of EGFR DNA or RNA comprising a mutation at a position corresponding to amino acid residue 761 of the EGFR polypeptide. In some embodiments, the polynucleic acid molecule hybridizes to a target region of EGFR DNA or RNA comprising a mutation at a position corresponding to amino acid residue 790 of the EGFR polypeptide. In some embodiments, the polynucleic acid molecule hybridizes to a target region of EGFR DNA or RNA comprising a mutation at a position corresponding to amino acid residue 854 of the EGFR polypeptide. In some embodiments, the polynucleic acid molecule hybridizes to a target region of EGFR DNA or RNA comprising a mutation at a position corresponding to amino acid residue 858 of the EGFR polypeptide.

In some embodiments, a polynucleic acid molecule hybridizes to a target region of EGFR DNA or RNA comprising one or more mutations selected from T34M, L38V, E45Q, L62R, G63R, G63K, S77F, F78L, R108K, R108G, E114K, A120P, L140V, V148M, R149W, E160K, S177P, M178I, K189T, D191N, S198R, S220P, R222L, R222C, S223Y, S229C, A237Y, C240Y, R244G, R252C, R252P, F254I, R255 (nonsense mutation), D256Y, T263P, Y270C, T273A, Q276 (nonsense), E282K, G288 (frame shift), A289D, A289V, A289T, A289N, A289D, V301 (deletion), D303H, H304Y, R309Q, D314N, C326R, G331R, T354M, T363I, P373Q, R337S, S380 (frame shift), T384S, D393Y, R427L, G428S, S437Y, V441I, S447Y, I475V, C515S, C526S, R527L, R531 (nonsense), V536M, L541I, P546Q, C571S, G588S, P589L, P596L, P596S, P596R, P596L, G598V, G598A, E602G, G614D, C620Y, C620W, C628Y, C628F, C636Y, T638M, P641H, S645C, V651M, R671C, V689M, P694S, N700D, E709A, E709K, E709Q, E709K, F712L, K714N, I715S, K716R, G719A, G719C, G719D, G719S, G720C, S720F, G721V, W731Stop, P733L, K739-I744 (insertion), V742I, V742A, E746-A750 (deletion), E746K, L747S, L747-E749 (deletion), L747-T751 (deletion), L747-P753 (deletion), G746-S752 (deletion), T751I, S752Y, K754 (deletion), S752-I759 (deletion), A750P, D761-E762 (e.g., residues EAFQ (SEQ ID NO: 1893) insertion), D761N, D761Y, A763V, V765A, A767-S768 (e.g., residues TLA insertion), A767-V769 (e.g., residues ASV insertion), S768I, S768T, V769L, V769M, V769-D770 (e.g., residue Y insertion), 770-771 (e.g., residues GL insertion), 770-771 (e.g., residue G insertion), 770-771 (e.g., residues CV insertion), 770-771 (e.g., residues SVD insertion), P772R, 773-774 (e.g., residues NPH insertion), H773R, H773L, V774M, 774-775 (e.g., residues HV insertion), R776H, R776C, G779F, T783A, T784F, T854A, V786L, T790M, L792P, P794H, L798F, R803W, H805R, D807H, G810S, N826S, Y827 (nonsense), R831H, R832C, R832H, L833F, L833V, H835L, D837V, L838M, L838P, A839V, N842H, V843L, T847K, T847I, H850N, V851A, I853T, F856L, L858R, L858M, L861Q, L861R, G863D, Q894L, G917A, E967A, D1006Y, P1019L, S1042N, R1100S, H1129Y, T1141S, S1153I, Q1164R, L1167M, or a combination thereof of the EGFR polypeptide. In some embodiments, the polynucleic acid molecule hybridizes to a target region of EGFR DNA or RNA comprising one or more mutations selected from L747S, D761Y, T790M, T854A, L858R, or a combination thereof of the EGFR polypeptide. In some embodiments, the polynucleic acid molecule hybridizes to a target region of EGFR DNA or RNA comprising one or more mutations selected from D761Y, T790M, L858R, or a combination thereof of the EGFR polypeptide. In some embodiments, the polynucleic acid molecule hybridizes to a target region of EGFR DNA or RNA comprising mutation L747S of the EGFR polypeptide. In some embodiments, the polynucleic acid molecule hybridizes to a target region of EGFR DNA or RNA comprising mutation D761Y of the EGFR polypeptide. In some embodiments, the polynucleic acid molecule hybridizes to a target region of EGFR DNA or RNA comprising mutation T790M of the EGFR polypeptide. In some embodiments, the polynucleic acid molecule hybridizes to a target region of EGFR DNA or RNA comprising mutation T854A of the EGFR polypeptide. In some embodiments, the polynucleic acid molecule hybridizes to a target region of EGFR DNA or RNA comprising mutation L858R of the EGFR polypeptide.

In some embodiments, a polynucleic acid molecule comprises a sequence that hybridizes to a target sequence illustrated in Table 1. In some embodiments, the polynucleic acid molecule hybridizes to an EGFR target sequence selected from SEQ ID NOs: 1-376. In some cases, the polynucleic acid molecule hybridizes to an EGFR target sequence selected from SEQ ID NOs: 1-376 with less than 5 mismatched bases, with less than 4 mismatched bases, with less than 3 mismatched bases, with less than 2 mismatched bases, or with 1 mismatched base. In some cases, the polynucleic acid molecule hybridizes to an EGFR target sequence selected from SEQ ID NOs: 1-376 with less than 4 mismatched bases.

In some embodiments, a polynucleic acid molecule comprises a sequence having at least 50%, 55%, 60%, 65%, 70%, 75%, 80%, 85%, 90%, 95%, 96%, 97%, 98%, 99%, or 100% sequence identity to a sequence listed in Table 2, Table 3, or Table 6. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 377-1892. In some embodiments, the polynucleic acid molecule comprises a sequence having at least 50% sequence identity to SEQ ID NOs: 377-1892. In some embodiments, the polynucleic acid molecule comprises a sequence having at least 60% sequence identity to SEQ ID NOs: 377-1892. In some embodiments, the polynucleic acid molecule comprises a sequence having at least 70% sequence identity to SEQ ID NOs: 377-1892. In some embodiments, the polynucleic acid molecule comprises a sequence having at least 75% sequence identity to SEQ ID NOs: 377-1892. In some embodiments, the polynucleic acid molecule comprises a sequence having at least 80% sequence identity to SEQ ID NOs: 377-1892. In some embodiments, the polynucleic acid molecule comprises a sequence having at least 85% sequence identity to SEQ ID NOs: 377-1892. In some embodiments, the polynucleic acid molecule comprises a sequence having at least 90% sequence identity to SEQ ID NOs: 377-1892. In some embodiments, the polynucleic acid molecule comprises a sequence having at least 95% sequence identity to SEQ ID NOs: 377-1892. In some embodiments, the polynucleic acid molecule comprises a sequence having at least 96% sequence identity to SEQ ID NOs: 377-1892. In some embodiments, the polynucleic acid molecule comprises a sequence having at least 97% sequence identity to SEQ ID NOs: 377-1892. In some embodiments, the polynucleic acid molecule comprises a sequence having at least 98% sequence identity to SEQ ID NOs: 377-1892. In some embodiments, the polynucleic acid molecule comprises a sequence having at least 99% sequence identity to SEQ ID NOs: 377-1892. In some embodiments, the polynucleic acid molecule consists of SEQ ID NOs: 377-1892.

In some embodiments, a polynucleic acid molecule comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 377-1892. In some cases, the second polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 377-1892. In some cases, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 377-1892 and a second polynucleotide having at least 50%, 55%, 60%, 65%, 70%, 75%, 80%, 85%, 90%, 95%, 96%, 97%, 98%, 99%, or 100% sequence identity to SEQ ID NOs: 377-1892.

In some embodiments, a polynucleic acid molecule described herein comprises RNA or DNA. In some cases, the polynucleic acid molecule comprises RNA. In some instances, RNA comprises short interfering RNA (siRNA), short hairpin RNA (shRNA), microRNA (miRNA), double-stranded RNA (dsRNA), transfer RNA (tRNA), ribosomal RNA (rRNA), or heterogeneous nuclear RNA (hnRNA). In some instances, RNA comprises shRNA. In some instances, RNA comprises miRNA. In some instances, RNA comprises dsRNA. In some instances, RNA comprises tRNA. In some instances, RNA comprises rRNA. In some instances, RNA comprises hnRNA. In some instances, the RNA comprises siRNA. In some instances, the polynucleic acid molecule comprises siRNA.

In some embodiments, a polynucleic acid molecule described herein is from about 10 to about 50 nucleotides in length. In some instances, the polynucleic acid molecule is from about 10 to about 30, from about 15 to about 30, from about 18 to about 25, from about 18 to about 24, from about 19 to about 23, or from about 20 to about 22 nucleotides in length.

In some embodiments, a polynucleic acid molecule is about 50 nucleotides in length. In some instances, the polynucleic acid molecule is about 45 nucleotides in length. In some instances, the polynucleic acid molecule is about 40 nucleotides in length. In some instances, the polynucleic acid molecule is about 35 nucleotides in length. In some instances, the polynucleic acid molecule is about 30 nucleotides in length. In some instances, the polynucleic acid molecule is about 25 nucleotides in length. In some instances, the polynucleic acid molecule is about 20 nucleotides in length. In some instances, the polynucleic acid molecule is about 19 nucleotides in length. In some instances, the polynucleic acid molecule is about 18 nucleotides in length. In some instances, the polynucleic acid molecule is about 17 nucleotides in length. In some instances, the polynucleic acid molecule is about 16 nucleotides in length. In some instances, the polynucleic acid molecule is about 15 nucleotides in length. In some instances, the polynucleic acid molecule is about 14 nucleotides in length. In some instances, the polynucleic acid molecule is about 13 nucleotides in length. In some instances, the polynucleic acid molecule is about 12 nucleotides in length. In some instances, the polynucleic acid molecule is about 11 nucleotides in length. In some instances, the polynucleic acid molecule is about 10 nucleotides in length. In some instances, the polynucleic acid molecule is between about 10 and about 50 nucleotides in length. In some instances, the polynucleic acid molecule is from about 10 to about 45 nucleotides in length. In some instances, the polynucleic acid molecule is from about 10 to about 40 nucleotides in length. In some instances, the polynucleic acid molecule is from about 10 to about 35 nucleotides in length. In some instances, the polynucleic acid molecule is from about 10 to about 30 nucleotides in length. In some instances, the polynucleic acid molecule is from about 10 to about 25 nucleotides in length. In some instances, the polynucleic acid molecule is from about 10 to about 20 nucleotides in length. In some instances, the polynucleic acid molecule is from about 15 to about 25 nucleotides in length. In some instances, the polynucleic acid molecule is from about 15 to about 30 nucleotides in length. In some instances, the polynucleic acid molecule is from about 12 to about 30 nucleotides in length.

In some embodiments, a polynucleic acid molecule described herein comprises a first polynucleotide. In some instances, the polynucleic acid molecule comprises a second polynucleotide. In some instances, the polynucleic acid molecule comprises a first polynucleotide and a second polynucleotide. In some instances, the first polynucleotide is a sense strand or passenger strand. In some instances, the second polynucleotide is an antisense strand or guide strand.

In some embodiments, a polynucleic acid molecule is a first polynucleotide. In some embodiments, the first polynucleotide is from about 10 to about 50 nucleotides in length. In some instances, the first polynucleotide is from about 10 to about 30, from about 15 to about 30, from about 18 to about 25, from about 18 to about 24, from about 19 to about 23, or from about 20 to about 22 nucleotides in length.

In some instances, a first polynucleotide is about 50 nucleotides in length. In some instances, the first polynucleotide is about 45 nucleotides in length. In some instances, the first polynucleotide is about 40 nucleotides in length. In some instances, the first polynucleotide is about 35 nucleotides in length. In some instances, the first polynucleotide is about 30 nucleotides in length. In some instances, the first polynucleotide is about 25 nucleotides in length. In some instances, the first polynucleotide is about 20 nucleotides in length. In some instances, the first polynucleotide is about 19 nucleotides in length. In some instances, the first polynucleotide is about 18 nucleotides in length. In some instances, the first polynucleotide is about 17 nucleotides in length. In some instances, the first polynucleotide is about 16 nucleotides in length. In some instances, the first polynucleotide is about 15 nucleotides in length. In some instances, the first polynucleotide is about 14 nucleotides in length. In some instances, the first polynucleotide is about 13 nucleotides in length. In some instances, the first polynucleotide is about 12 nucleotides in length. In some instances, the first polynucleotide is about 11 nucleotides in length. In some instances, the first polynucleotide is about 10 nucleotides in length. In some instances, the first polynucleotide is from about 10 to about 50 nucleotides in length. In some instances, the first polynucleotide is from about 10 to about 45 nucleotides in length. In some instances, the first polynucleotide is from about 10 to about 40 nucleotides in length. In some instances, the first polynucleotide is from about 10 to about 35 nucleotides in length. In some instances, the first polynucleotide is from about 10 to about 30 nucleotides in length. In some instances, the first polynucleotide is from about 10 to about 25 nucleotides in length. In some instances, the first polynucleotide is from about 10 to about 20 nucleotides in length. In some instances, the first polynucleotide is from about 15 to about 25 nucleotides in length. In some instances, the first polynucleotide is from about 15 to about 30 nucleotides in length. In some instances, the first polynucleotide is from about 12 to about 30 nucleotides in length.

In some embodiments, a polynucleic acid molecule is a second polynucleotide. In some embodiments, the second polynucleotide is from about 10 to about 50 nucleotides in length. In some instances, the second polynucleotide is from about 10 to about 30, from about 15 to about 30, from about 18 to about 25, from about 18 to about 24, from about 19 to about 23, or from about 20 to about 22 nucleotides in length.

In some instances, a second polynucleotide is about 50 nucleotides in length. In some instances, the second polynucleotide is about 45 nucleotides in length. In some instances, the second polynucleotide is about 40 nucleotides in length. In some instances, the second polynucleotide is about 35 nucleotides in length. In some instances, the second polynucleotide is about 30 nucleotides in length. In some instances, the second polynucleotide is about 25 nucleotides in length. In some instances, the second polynucleotide is about 20 nucleotides in length. In some instances, the second polynucleotide is about 19 nucleotides in length. In some instances, the second polynucleotide is about 18 nucleotides in length. In some instances, the second polynucleotide is about 17 nucleotides in length. In some instances, the second polynucleotide is about 16 nucleotides in length. In some instances, the second polynucleotide is about 15 nucleotides in length. In some instances, the second polynucleotide is about 14 nucleotides in length. In some instances, the second polynucleotide is about 13 nucleotides in length. In some instances, the second polynucleotide is about 12 nucleotides in length. In some instances, the second polynucleotide is about 11 nucleotides in length. In some instances, the second polynucleotide is about 10 nucleotides in length. In some instances, the second polynucleotide is from about 10 to about 50 nucleotides in length. In some instances, the second polynucleotide is from about 10 to about 45 nucleotides in length. In some instances, the second polynucleotide is from about 10 to about 40 nucleotides in length. In some instances, the second polynucleotide is from about 10 to about 35 nucleotides in length. In some instances, the second polynucleotide is from about 10 to about 30 nucleotides in length. In some instances, the second polynucleotide is from about 10 to about 25 nucleotides in length. In some instances, the second polynucleotide is from about 10 to about 20 nucleotides in length. In some instances, the second polynucleotide is from about 15 to about 25 nucleotides in length. In some instances, the second polynucleotide is from about 15 to about 30 nucleotides in length. In some instances, the second polynucleotide is from about 12 to about 30 nucleotides in length.

In some embodiments, a polynucleic acid molecule comprises a first polynucleotide and a second polynucleotide. In some instances, the polynucleic acid molecule further comprises a blunt terminus, an overhang, or a combination thereof. In some instances, the blunt terminus is a 5' blunt terminus, a 3' blunt terminus, or both. In some cases, the overhang is a 5' overhang, 3' overhang, or both. In some cases, the overhang comprises 1, 2, 3, 4, 5, 6, 7, 8, 9, or 10 non-base pairing nucleotides. In some cases, the overhang comprises 1, 2, 3, 4, 5, or 6 non-base pairing nucleotides. In some cases, the overhang comprises 1, 2, 3, or 4 non-base pairing nucleotides. In some cases, the overhang comprises 1 non-base pairing nucleotide. In some cases, the overhang comprises 2 non-base pairing nucleotides. In some cases, the overhang comprises 3 non-base pairing nucleotides. In some cases, the overhang comprises 4 non-base pairing nucleotides.

In some embodiments, the sequence of a polynucleic acid molecule is at least 40%, 50%, 55%, 60%, 65%, 70%, 75%, 80%, 85%, 90%, 95%, 98%, 99%, or 99.5% complementary to a target sequence described herein. In some embodiments, the sequence of the polynucleic acid molecule is at least 50% complementary to a target sequence described herein. In some embodiments, the sequence of the polynucleic acid molecule is at least 60% complementary to a target sequence described herein. In some embodiments, the sequence of the polynucleic acid molecule is at least 70% complementary to a target sequence described herein. In some embodiments, the sequence of the polynucleic acid molecule is at least 80% complementary to a target sequence described herein. In some embodiments, the sequence of the polynucleic acid molecule is at least 90% complementary to a target sequence described herein. In some embodiments, the sequence of the polynucleic acid molecule is at least 95% complementary to a target sequence described herein. In some embodiments, the sequence of the polynucleic acid molecule is at least 99% complementary to a target sequence described herein. In some instances, the sequence of the polynucleic acid molecule is 100% complementary to a target sequence described herein.

In some embodiments, the sequence of a polynucleic acid molecule has 5 or less mismatches to a target sequence described herein. In some embodiments, the sequence of the polynucleic acid molecule has 4 or less mismatches to a target sequence described herein. In some instances, the sequence of the polynucleic acid molecule has 3 or less mismatches to a target sequence described herein. In some cases, the sequence of the polynucleic acid molecule has 2 or less mismatches to a target sequence described herein. In some cases, the sequence of the polynucleic acid molecule has 1 or less mismatches to a target sequence described herein.

In some embodiments, the specificity of a polynucleic acid molecule that hybridizes to a target sequence described herein is a 95%, 98%, 99%, 99.5% or 100% sequence complementarity of the polynucleic acid molecule to a target sequence. In some instances, the hybridization is a high stringent hybridization condition.

In some embodiments, the polynucleic acid molecule hybridizes to at least 8, 9, 10, 11, 12, 13, 14, 15, 16, 17, 18, 19, 20, or more contiguous bases of a target sequence described herein. In some embodiments, the polynucleic acid molecule hybridizes to at least 8 contiguous bases of a target sequence described herein. In some embodiments, the polynucleic acid molecule hybridizes to at least 9 contiguous bases of a target sequence described herein. In some embodiments, the polynucleic acid molecule hybridizes to at least 10 contiguous bases of a target sequence described herein. In some embodiments, the polynucleic acid molecule hybridizes to at least 11 contiguous bases of a target sequence described herein. In some embodiments, the polynucleic acid molecule hybridizes to at least 12 contiguous bases of a target sequence described herein. In some embodiments, the polynucleic acid molecule hybridizes to at least 15 contiguous bases of a target sequence described herein. In some embodiments, the polynucleic acid molecule hybridizes to at least 18 contiguous bases of a target sequence described herein.

In some embodiments, a polynucleic acid molecule has reduced off-target effect. In some instances, "off-target" or "off-target effects" refer to any instance in which a polynucleic acid polymer directed against a given target causes an unintended effect by interacting either directly or indirectly with another mRNA sequence, a DNA sequence or a cellular protein or other moiety. In some instances, an "off-target effect" occurs when there is a simultaneous degradation of other transcripts due to partial homology or complementarity between that other transcript and the sense and/or antisense strand of the polynucleic acid molecule.

In some embodiments, a polynucleic acid molecule comprises natural, synthetic, or artificial nucleotide analogues or bases. In some cases, the polynucleic acid molecule comprises combinations of DNA, RNA and/or nucleotide analogues. In some instances, the synthetic or artificial nucleotide analogues or bases comprise modifications at one or more of ribose moiety, phosphate moiety, nucleoside moiety, or a combination thereof.

In some embodiments, nucleotide analogues or artificial nucleotide base comprise a nucleic acid with a modification at a 2' hydroxyl group of the ribose moiety. In some instances, the modification includes an H, OR, R, halo, SH, SR, NH2, NHR, NR2, or CN, wherein R is an alkyl moiety. Exemplary alkyl moiety includes, but is not limited to, halogens, sulfurs, thiols, thioethers, thioesters, amines (primary, secondary, or tertiary), amides, ethers, esters, alcohols and oxygen. In some instances, the alkyl moiety further comprises a modification. In some instances, the modification comprises an azo group, a keto group, an aldehyde group, a carboxyl group, a nitro group, a nitroso, group, a nitrile group, a heterocycle (e.g., imidazole, hydrazino or hydroxylamino) group, an isocyanate or cyanate group, or a sulfur containing group (e.g., sulfoxide, sulfone, sulfide, or disulfide). In some instances, the alkyl moiety further comprises a hetero substitution. In some instances, the carbon of the heterocyclic group is substituted by a nitrogen, oxygen or sulfur. In some instances, the heterocyclic substitution includes but is not limited to, morpholino, imidazole, and pyrrolidino.

In some instances, the modification at the 2' hydroxyl group is a 2'-O-methyl modification or a 2'-O-methoxyethyl (2'-O-MOE) modification. In some cases, the 2'-O-methyl modification adds a methyl group to the 2' hydroxyl group of the ribose moiety whereas the 2'O-methoxyethyl modification adds a methoxyethyl group to the 2' hydroxyl group of the ribose moiety. Exemplary chemical structures of a 2'-O-methyl modification of an adenosine molecule and 2'O-methoxyethyl modification of a uridine are illustrated below.

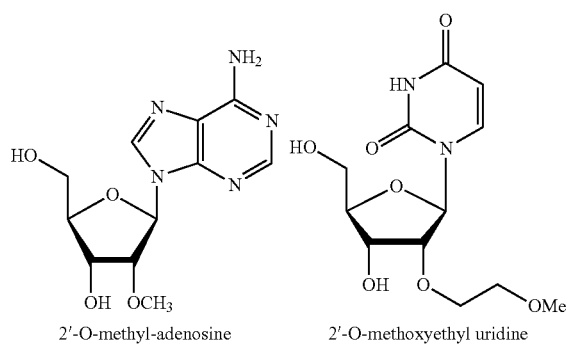

2'-O-methyl-adenosine     2'-O-methoxyethyl uridine

In some instances, the modification at the 2' hydroxyl group is a 2'-O-aminopropyl modification in which an extended amine group comprising a propyl linker binds the amine group to the 2' oxygen. In some instances, this modification neutralizes the phosphate-derived overall negative charge of the oligonucleotide molecule by introducing one positive charge from the amine group per sugar and thereby improves cellular uptake properties due to its zwitterionic properties. An exemplary chemical structure of a 2'-O-aminopropyl nucleoside phosphoramidite is illustrated below.

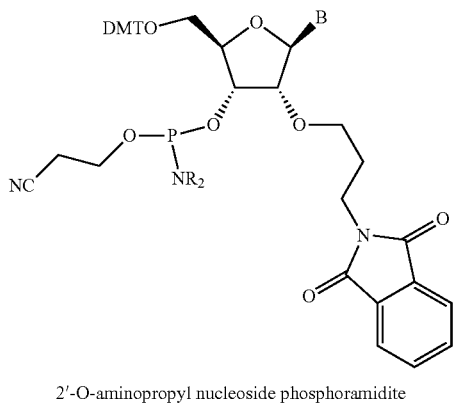

2'-O-aminopropyl nucleoside phosphoramidite

In some instances, the modification at the 2' hydroxyl group is a locked or bridged ribose modification (e.g., locked nucleic acid or LNA) in which the oxygen molecule bound at the 2' carbon is linked to the 4' carbon by a methylene group, thus forming a 2'-C,4'-C-oxy-methylene-linked bicyclic ribonucleotide monomer. Exemplary representations of the chemical structure of LNA are illustrated below. The representation shown to the left highlights the chemical connectivities of an LNA monomer. The representation shown to the right highlights the locked 3'-endo ($^3$E) conformation of the furanose ring of an LNA monomer.

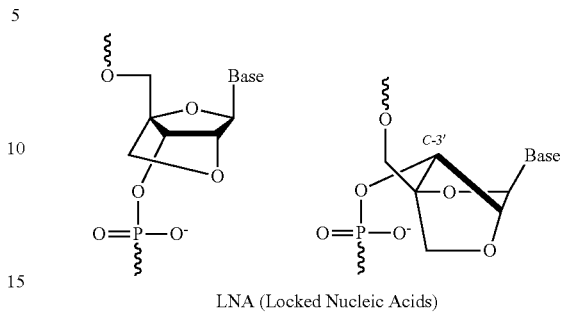

LNA (Locked Nucleic Acids)

In some instances, the modification at the 2' hydroxyl group comprises ethylene nucleic acids (ENA) such as for example 2'-4'-ethylene-bridged nucleic acid, which locks the sugar conformation into a $C_3$'-endo sugar puckering conformation. ENA are part of the bridged nucleic acids class of modified nucleic acids that also comprises LNA. Exemplary chemical structures of the ENA and bridged nucleic acids are illustrated below.

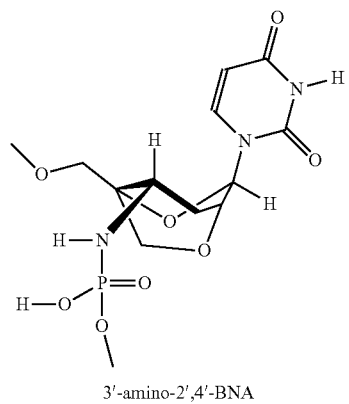

3'-amino-2',4'-BNA

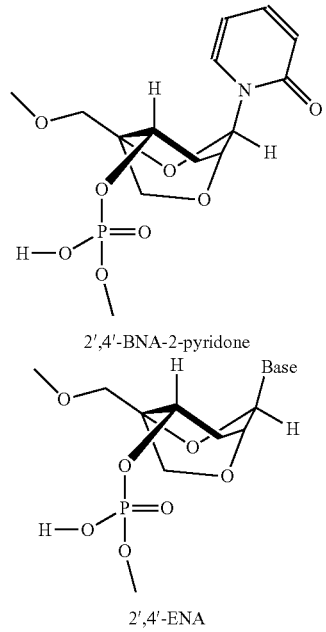

2',4'-BNA-2-pyridone

2',4'-ENA

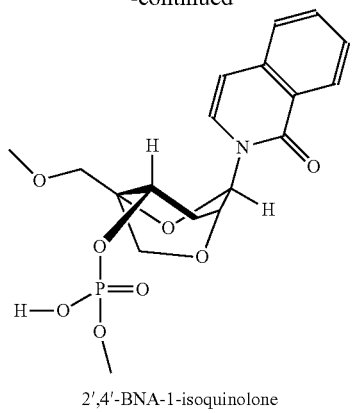

2',4'-BNA-1-isoquinolone

In some embodiments, additional modifications at the 2' hydroxyl group include 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA).

In some embodiments, nucleotide analogues comprise modified bases such as, but not limited to, 5-propynyluridine, 5-propynylcytidine, 6-methyladenine, 6-methylguanine, N,N,-dimethyladenine, 2-propyladenine, 2-propylguanine, 2-aminoadenine, 1-methylinosine, 3-methyluridine, 5-methylcytidine, 5-methyluridine and other nucleotides having a modification at the 5 position, 5-(2-amino) propyl uridine, 5-halocytidine, 5-halouridine, 4-acetylcytidine, 1-methyladenosine, 2-methyladenosine, 3-methylcytidine, 6-methyluridine, 2-methylguanosine, 7-methylguanosine, 2,2-dimethylguanosine, 5-methylaminoethyluridine, 5-methyloxyuridine, deazanucleotides (such as 7-deaza-adenosine, 6-azouridine, 6-azocytidine, or 6-azothymidine), 5-methyl-2-thiouridine, other thio bases (such as 2-thiouridine, 4-thiouridine, and 2-thiocytidine), dihydrouridine, pseudouridine, queuosine, archaeosine, naphthyl and substituted naphthyl groups, any O-and N-alkylated purines and pyrimidines (such as N6-methyladenosine, 5-methylcarbonylmethyluridine, uridine 5-oxyacetic acid, pyridine-4-one, or pyridine-2-one), phenyl and modified phenyl groups (such as aminophenol or 2,4,6-trimethoxy benzene), modified cytosines that act as G-clamp nucleotides, 8-substituted adenines and guanines, 5-substituted uracils and thymines, azapyrimidines, carboxyhydroxyalkyl nucleotides, carboxyalkylaminoalkyi nucleotides, and alkylcarbonylalkylated nucleotides. Modified nucleotides also include those nucleotides that are modified with respect to the sugar moiety, as well as nucleotides having sugars or analogs thereof that are not ribosyl. For example, the sugar moieties, in some cases, are or are based on mannoses, arabinoses, glucopyranoses, galactopyranoses, 4'-thioribose, and other sugars, heterocycles, or carbocycles. The term nucleotide also includes what are known in the art as universal bases. By way of example, universal bases include, but are not limited to, 3-nitropyrrole, 5-nitroindole, or nebularine.

In some embodiments, nucleotide analogues further comprise morpholinos, peptide nucleic acids (PNAs), methylphosphonate nucleotides, thiolphosphonate nucleotides, 2'-fluoro N3-P5'-phosphoramidites, 1',5'-anhydrohexitol nucleic acids (HNAs), or a combination thereof. Morpholino or phosphorodiamidate morpholino oligo (PMO) comprises synthetic molecules whose structure mimics natural nucleic acid structure but deviates from the normal sugar and phosphate structures. In some instances, the five member ribose ring is substituted with a six member morpholino ring containing four carbons, one nitrogen, and one oxygen. In some cases, the ribose monomers are linked by a phosphordiamidate group instead of a phosphate group. In such cases, the backbone alterations remove all positive and negative charges making morpholinos neutral molecules capable of crossing cellular membranes without the aid of cellular delivery agents such as those used by charged oligonucleotides.

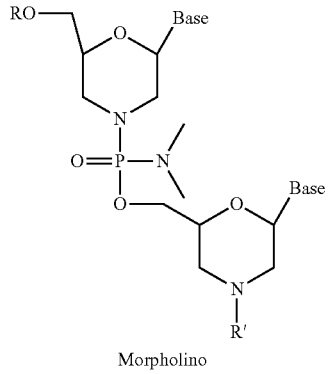

Morpholino

In some embodiments, peptide nucleic acid (PNA) does not contain sugar ring or phosphate linkage and the bases are attached and appropriately spaced by oligoglycine-like molecules, therefore eliminating a backbone charge.

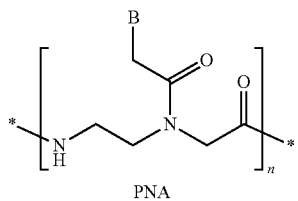

PNA

In some embodiments, one or more modifications optionally occur at the internucleotide linkage. In some instances, modified internucleotide linkage includes, but is not limited to, phosphorothioates; phosphorodithioates; methylphosphonates; 5'-alkylenephosphonates; 5'-methylphosphonate; 3'-alkylene phosphonates; borontrifluoridates; borano phosphate esters and selenophosphates of 3'-5'linkage or 2'-5'linkage; phosphotriesters; thionoalkylphosphotriesters; hydrogen phosphonate linkages; alkyl phosphonates; alkylphosphonothioates; arylphosphonothioates; phosphoroselenoates; phosphorodiselenoates; phosphinates; phosphoramidates; 3'-alkylphosphoramidates; aminoalkylphosphoramidates; thionophosphoramidates; phosphoropiperazidates; phosphoroanilothioates; phosphoroanilidates; ketones; sulfones; sulfonamides; carbonates; carbamates; methylenehydrazos; methylenedimethylhydrazos; formacetals; thioformacetals; oximes; methyleneiminos; methylenemethyliminos; thioamidates; linkages with riboacetyl groups; aminoethyl glycine; silyl or siloxane linkages; alkyl or cycloalkyl linkages with or without heteroatoms of, for example, 1 to 10 carbons that are saturated or unsaturated and/or substituted and/or contain heteroatoms; linkages with morpholino structures, amides, or polyamides wherein the bases are attached to the aza nitrogens of the backbone directly or indirectly; and combinations thereof.

In some instances, the modification is a methyl or thiol modification such as methylphosphonate or thiolphosphonate modification. Exemplary thiolphosphonate nucleotide (left) and methylphosphonate nucleotide (right) are illustrated below.

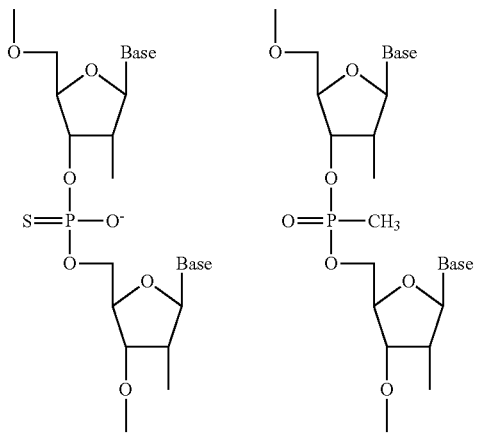

In some instances, a modified nucleotide includes, but is not limited to, 2'-fluoro N3-P5'-phosphoramidites illustrated as:

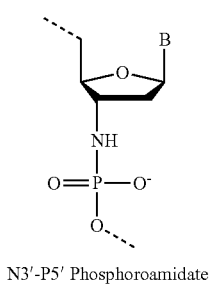

N3'-P5' Phosphoroamidate

In some instances, a modified nucleotide includes, but is not limited to, hexitol nucleic acid (or 1',5'-anhydrohexitol nucleic acids (HNA)) illustrated as:

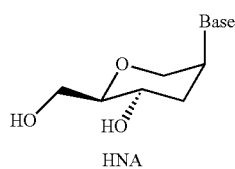

HNA

In some embodiments, one or more modifications further optionally include modifications of the ribose moiety, phosphate backbone and the nucleoside, or modifications of the nucleotide analogues at the 3' or the 5' terminus. For example, the 3' terminus optionally include a 3' cationic group, or by inverting the nucleoside at the 3'-terminus with a 3'-3' linkage. In another alternative, the 3'-terminus is optionally conjugated with an aminoalkyl group, e.g., a 3' C5-aminoalkyl dT. In an additional alternative, the 3'-terminus is optionally conjugated with an abasic site, e.g., with an apurinic or apyrimidinic site. In some instances, the 5'-terminus is conjugated with an aminoalkyl group, e.g., a 5'-O-alkylamino substituent. In some cases, the 5'-terminus is conjugated with an abasic site, e.g., with an apurinic or apyrimidinic site.

In some embodiments, a polynucleic acid molecule comprises one or more artificial nucleotide analogues described herein. In some instances, the polynucleic acid molecule comprises 1, 2, 3, 4, 5, 6, 7, 8, 9, 10, 11, 12, 13, 14, 15, 16, 17, 18, 20, 25, or more artificial nucleotide analogues described herein. In some embodiments, the artificial nucleotide analogues include 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the polynucleic acid molecule comprises 1, 2, 3, 4, 5, 6, 7, 8, 9, 10, 11, 12, 13, 14, 15, 16, 17, 18, 20, 25, or more of the artificial nucleotide analogues selected from 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the polynucleic acid molecule comprises 1, 2, 3, 4, 5, 6, 7, 8, 9, 10, 11, 12, 13, 14, 15, 16, 17, 18, 20, 25, or more of 2'-O-methyl modified nucleotides. In some instances, the polynucleic acid molecule comprises 1, 2, 3, 4, 5, 6, 7, 8, 9, 10, 11, 12, 13, 14, 15, 16, 17, 18, 20, 25, or more of 2'-O-methoxyethyl (2'-O-MOE) modified nucleotides. In some instances, the polynucleic acid molecule comprises 1, 2, 3, 4, 5, 6, 7, 8, 9, 10, 11, 12, 13, 14, 15, 16, 17, 18, 20, 25, or more of thiolphosphonate nucleotides.

In some instances, a polynucleic acid molecule comprises at least one of: from about 5% to about 100% modification, from about 10% to about 100% modification, from about 20% to about 100% modification, from about 30% to about 100% modification, from about 40% to about 100% modification, from about 50% to about 100% modification, from about 60% to about 100% modification, from about 70% to about 100% modification, from about 80% to about 100% modification, and from about 90% to about 100% modification. In some instances, the polynucleic acid molecule is a polynucleic acid molecule of SEQ ID NOs: 377-1128.

In some cases, a polynucleic acid molecule comprises at least one of: from about 10% to about 90% modification, from about 20% to about 90% modification, from about 30% to about 90% modification, from about 40% to about 90% modification, from about 50% to about 90% modification, from about 60% to about 90% modification, from about 70% to about 90% modification, and from about 80% to about 100% modification. In some instances, the polynucleic acid molecule is a polynucleic acid molecule of SEQ ID NOs: 377-1128.

In some cases, a polynucleic acid molecule comprises at least one of: from about 10% to about 80% modification, from about 20% to about 80% modification, from about 30% to about 80% modification, from about 40% to about 80% modification, from about 50% to about 80% modification, from about 60% to about 80% modification, and from about 70% to about 80% modification. In some instances, the polynucleic acid molecule is a polynucleic acid molecule of SEQ ID NOs: 377-1128.

In some instances, a polynucleic acid molecule comprises at least one of: from about 10% to about 70% modification, from about 20% to about 70% modification, from about 30% to about 70% modification, from about 40% to about 70% modification, from about 50% to about 70% modification, and from about 60% to about 70% modification. In some instances, the polynucleic acid molecule is a polynucleic acid molecule of SEQ ID NOs: 377-1128.

In some instances, a polynucleic acid molecule comprises at least one of: from about 10% to about 60% modification, from about 20% to about 60% modification, from about 30% to about 60% modification, from about 40% to about 60% modification, and from about 50% to about 60% modification. In some instances, the polynucleic acid molecule is a polynucleic acid molecule of SEQ ID NOs: 377-1128.

In some cases, a polynucleic acid molecule comprises at least one of: from about 10% to about 50% modification, from about 20% to about 50% modification, from about 30% to about 50% modification, and from about 40% to about 50% modification. In some instances, the polynucleic acid molecule is a polynucleic acid molecule of SEQ ID NOs: 377-1128.

In some cases, a polynucleic acid molecule comprises at least one of: from about 10% to about 40% modification, from about 20% to about 40% modification, and from about 30% to about 40% modification. In some instances, the polynucleic acid molecule is a polynucleic acid molecule of SEQ ID NOs: 377-1128.

In some cases, a polynucleic acid molecule comprises at least one of: from about 10% to about 30% modification, and from about 20% to about 30% modification. In some instances, the polynucleic acid molecule is a polynucleic acid molecule of SEQ ID NOs: 377-1128.

In some cases, a polynucleic acid molecule comprises from about 10% to about 20% modification. In some instances, the polynucleic acid molecule is a polynucleic acid molecule of SEQ ID NOs: 377-1128.

In some cases, a polynucleic acid molecule comprises from about 15% to about 90%, from about 20% to about 80%, from about 30% to about 70%, or from about 40% to about 60% modifications. In some instances, the polynucleic acid molecule is a polynucleic acid molecule of SEQ ID NOs: 377-1128.

In additional cases, a polynucleic acid molecule comprises at least about 15%, 20%, 30%, 40%, 50%, 60%, 70%, 80%, 90%, 95%, or 99% modification. In some instances, the polynucleic acid molecule is a polynucleic acid molecule of SEQ ID NOs: 377-1128.

In some embodiments, a polynucleic acid molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, or more modifications. In some instances, the polynucleic acid molecule is a polynucleic acid molecule of SEQ ID NOs: 377-1128.

In some instances, a polynucleic acid molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, or more modified nucleotides. In some instances, the polynucleic acid molecule is a polynucleic acid molecule of SEQ ID NOs: 377-1128.

In some instances, from about 5 to about 100% of a polynucleic acid molecule comprise an artificial nucleotide analogue described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of the polynucleic acid molecule comprise an artificial nucleotide analogue described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 377-1892 comprise an artificial nucleotide analogue described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 377-1128 comprise an artificial nucleotide analogue described herein. In some instances, about 5% of a polynucleic acid molecule of SEQ ID NOs: 377-1128 comprise an artificial nucleotide analogue described herein. In some instances, about 10% of a polynucleic acid molecule of SEQ ID NOs: 377-1128 comprise an artificial nucleotide analogue described herein. In some instances, about 15% of a polynucleic acid molecule of SEQ ID NOs: 377-1128 comprise an artificial nucleotide analogue described herein. In some instances, about 20% of a polynucleic acid molecule of SEQ ID NOs: 377-1128 comprise an artificial nucleotide analogue described herein. In some instances, about 25% of a polynucleic acid molecule of SEQ ID NOs: 377-1128 comprise an artificial nucleotide analogue described herein. In some instances, about 30% of a polynucleic acid molecule of SEQ ID NOs: 377-1128 comprise an artificial nucleotide analogue described herein. In some instances, about 35% of a polynucleic acid molecule of SEQ ID NOs: 377-1128 comprise an artificial nucleotide analogue described herein. In some instances, about 40% of a polynucleic acid molecule of SEQ ID NOs: 377-1128 comprise an artificial nucleotide analogue described herein. In some instances, about 45% of a polynucleic acid molecule of SEQ ID NOs: 377-1128 comprise an artificial nucleotide analogue described herein. In some instances, about 50% of a polynucleic acid molecule of SEQ ID NOs: 377-1128 comprise an artificial nucleotide analogue described herein. In some instances, about 55% of a polynucleic acid molecule of SEQ ID NOs: 377-1128 comprise an artificial nucleotide analogue described herein. In some instances, about 60% of a polynucleic acid molecule of SEQ ID NOs: 377-1128 comprise an artificial nucleotide analogue described herein. In some instances, about 65% of a polynucleic acid molecule of SEQ ID NOs: 377-1128 comprise an artificial nucleotide analogue described herein. In some instances, about 70% of a polynucleic acid molecule of SEQ ID NOs: 377-1128 comprise an artificial nucleotide analogue described herein. In some instances, about 75% of a polynucleic acid molecule of SEQ ID NOs: 377-1128 comprise an artificial nucleotide analogue described herein. In some instances, about 80% of a polynucleic acid molecule of SEQ ID NOs: 377-1128 comprise an artificial nucleotide analogue described herein. In some instances, about 85% of a polynucleic acid molecule of SEQ ID NOs: 377-1128 comprise an artificial nucleotide analogue described herein. In some instances, about 90% of a polynucleic acid molecule of SEQ ID NOs: 377-1128 comprise an artificial nucleotide analogue described herein. In some instances, about 95% of a polynucleic acid molecule of SEQ ID NOs: 377-1128 comprise an artificial nucleotide analogue described herein. In some instances, about 96% of a polynucleic acid molecule of SEQ ID NOs: 377-1128 comprise an artificial nucleotide analogue described herein. In some instances, about 97% of a polynucleic acid molecule of SEQ ID NOs: 377-1128 comprise an artificial nucleotide analogue described herein. In some instances, about 98% of a polynucleic acid molecule of SEQ ID NOs: 377-1128 comprise an artificial nucleotide analogue described herein. In some instances, about 99% of a polynucleic acid molecule of SEQ ID NOs: 377-1128 comprise an artificial nucleotide analogue described herein. In some instances, about 100% of a polynucleic acid molecule of SEQ ID NOs: 377-1128 comprise an artificial nucleotide analogue described herein. In some embodiments, the artificial nucleotide analogue comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof.

In some embodiments, a polynucleic acid molecule comprises from about 1 to about 25 modifications in which the modification comprises an artificial nucleotide analogues described herein. In some embodiments, a polynucleic acid molecule of SEQ ID NOs: 377-1128 comprises from about 1 to about 25 modifications in which the modifications comprise an artificial nucleotide analogue described herein. In some embodiments, a polynucleic acid molecule of SEQ ID NOs: 377-1128 comprises about 1 modification in which the modification comprises an artificial nucleotide analogue described herein. In some embodiments, a polynucleic acid molecule of SEQ ID NOs: 377-1128 comprises about 2 modifications in which the modifications comprise an artificial nucleotide analogue described herein. In some embodiments, a polynucleic acid molecule of SEQ ID NOs: 377-1128 comprises about 3 modifications in which the modifications comprise an artificial nucleotide analogue described herein. In some embodiments, a polynucleic acid molecule of SEQ ID NOs: 377-1128 comprises about 4 modifications in which the modifications comprise an artificial nucleotide analogue described herein. In some embodiments, a polynucleic acid molecule of SEQ ID NOs: 377-1128 comprises about 5 modifications in which the modifications comprise an artificial nucleotide analogue described herein. In some embodiments, a polynucleic acid molecule of SEQ ID NOs: 377-1128 comprises about 6 modifications in which the modifications comprise an artificial nucleotide analogue described herein. In some embodiments, a polynucleic acid molecule of SEQ ID NOs: 377-1128 comprises about 7 modifications in which the modifications comprise an artificial nucleotide analogue described herein. In some embodiments, a polynucleic acid molecule of SEQ ID NOs: 377-1128 comprises about 8 modifications in which the modifications comprise an artificial nucleotide analogue described herein. In some embodiments, a polynucleic acid molecule of SEQ ID NOs: 377-1128 comprises about 9 modifications in which the modifications comprise an artificial nucleotide analogue described herein. In some embodiments, a polynucleic acid molecule of SEQ ID NOs: 377-1128 comprises about 10 modifications in which the modifications comprise an artificial nucleotide analogue described herein. In some embodiments, a polynucleic acid molecule of SEQ ID NOs: 377-1128 comprises about 11 modifications in which the modifications comprise an artificial nucleotide analogue described herein. In some embodiments, a polynucleic acid molecule of SEQ ID NOs: 377-1128 comprises about 12 modifications in which the modifications comprise an artificial nucleotide analogue described herein. In some embodiments, a polynucleic acid molecule of SEQ ID NOs: 377-1128 comprises about 13 modifications in which the modifications comprise an artificial nucleotide analogue described herein. In some embodiments, a polynucleic acid molecule of SEQ ID NOs: 377-1128 comprises about 14 modifications in which the modifications comprise an artificial nucleotide analogue described herein. In some embodiments, a polynucleic acid molecule of SEQ ID NOs: 377-1128 comprises about 15 modifications in which the modifications comprise an artificial nucleotide analogue described herein. In some embodiments, a polynucleic acid molecule of SEQ ID NOs: 377-1128 comprises about 16 modifications in which the modifications comprise an artificial nucleotide analogue described herein. In some embodiments, a polynucleic acid molecule of SEQ ID NOs: 377-1128 comprises about 17 modifications in which the modifications comprise an artificial nucleotide analogue described herein. In some embodiments, a polynucleic acid molecule of SEQ ID NOs: 377-1128 comprises about 18 modifications in which the modifications comprise an artificial nucleotide analogue described herein. In some embodiments, a polynucleic acid molecule of SEQ ID NOs: 377-1128 comprises about 19 modifications in which the modifications comprise an artificial nucleotide analogue described herein. In some embodiments, a polynucleic acid molecule of SEQ ID NOs: 377-1128 comprises about 20 modifications in which the modifications comprise an artificial nucleotide analogue described herein. In some embodiments, a polynucleic acid molecule of SEQ ID NOs: 377-1128 comprises about 21 modifications in which the modifications comprise an artificial nucleotide analogue described herein. In some embodiments, a polynucleic acid molecule of SEQ ID NOs: 377-1128 comprises about 22 modifications in which the modifications comprise an artificial nucleotide analogue described herein. In some embodiments, a polynucleic acid molecule of SEQ ID NOs: 377-1128 comprises about 23 modifications in which the modifications comprise an artificial nucleotide analogue described herein. In some embodiments, a polynucleic acid molecule of SEQ ID NOs: 377-1128 comprises about 24 modifications in which the modifications comprise an artificial nucleotide analogue described herein. In some embodiments, a polynucleic acid molecule of SEQ ID NOs: 377-1128 comprises about 25 modifications in which the modifications comprise an artificial nucleotide analogue described herein.

In some instances, a polynucleic acid molecule that comprises an artificial nucleotide analogue comprises a sequence selected from SEQ ID NOs: 1129-1892.

In some embodiments, a polynucleic acid molecule is assembled from two separate polynucleotides wherein one polynucleotide comprises the sense strand and the second polynucleotide comprises the antisense strand of the polynucleic acid molecule. In other embodiments, the sense strand is connected to the antisense strand via a linker molecule, which in some instances, is a polynucleotide linker or a non-nucleotide linker.

In some embodiments, a polynucleic acid molecule comprises a sense strand and antisense strand, wherein pyrimidine nucleotides in the sense strand comprise 2'-O-methylpyrimidine nucleotides and purine nucleotides in the sense strand comprise 2'-deoxy purine nucleotides. In some embodiments, a polynucleic acid molecule comprises a sense strand and antisense strand, wherein pyrimidine nucleotides present in the sense strand comprise 2'-deoxy- 2'-fluoro pyrimidine nucleotides and wherein purine nucleotides present in the sense strand comprise 2'-deoxy purine nucleotides.

In some embodiments, a polynucleic acid molecule comprises a sense strand and antisense strand, wherein the pyrimidine nucleotides when present in said antisense strand are 2'-deoxy-2'-fluoro pyrimidine nucleotides and the purine nucleotides when present in said antisense strand are 2'-O-methyl purine nucleotides.

In some embodiments, a polynucleic acid molecule comprises a sense strand and antisense strand, wherein the pyrimidine nucleotides when present in said antisense strand are 2'-deoxy-2'-fluoro pyrimidine nucleotides and wherein the purine nucleotides when present in said antisense strand comprise 2'-deoxy-purine nucleotides.

In some embodiments, a polynucleic acid molecule comprises a sense strand and antisense strand, wherein the sense strand includes a terminal cap moiety at the 5'-end, the 3'-end, or both of the 5' and 3' ends of the sense strand. In other embodiments, the terminal cap moiety is an inverted deoxy abasic moiety.

In some embodiments, a polynucleic acid molecule comprises a sense strand and an antisense strand, wherein the antisense strand comprises a phosphate backbone modification at the 3' end of the antisense strand. In some instances, the phosphate backbone modification is a phosphorothioate.

In some embodiments, a polynucleic acid molecule comprises a sense strand and an antisense strand, wherein the antisense strand comprises a glyceryl modification at the 3' end of the antisense strand.

In some embodiments, a polynucleic acid molecule comprises a sense strand and an antisense strand, in which the sense strand comprises one or more (for example, about 1, 2, 3, 4, 5, 6, 7, 8, 9, 10, 11, 12, 13, 14, 15, 16, 17, 18, 19, 20, or more) phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or about one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and in which the antisense strand comprises about 1 to about 10 or more, specifically about 1, 2, 3, 4, 5, 6, 7, 8, 9, 10, 11, 12, 13, 14, 15, 16, 17, 18, 19, 20, or more, phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more (for example about 1, 2, 3, 4, 5, 6, 7, 8, 9, 10, or more) pyrimidine nucleotides of the sense and/or antisense strand are chemically-modified with 2'-deoxy, 2'-O-methyl and/or 2'-deoxy-2'-fluoro nucleotides, with or without one or more (for example about 1, 2, 3, 4, 5, 6, 7, 8, 9, 10, or more) phosphorothioate internucleotide linkages and/or a terminal cap molecule at the 3'-end, the 5'-end, or both of the 3'- and 5'-ends, being present in the same or different strand.

In some embodiments, a polynucleic acid molecule comprises a sense strand and an antisense strand, in which the sense strand comprises about 1 to about 25 (for example, about 1, 2, 3, 4, 5, 6, 7, 8, 9, 10, 11, 12, 13, 14, 15, 16, 17, 18, 19, 20, or more) phosphorothioate internucleotide linkages, and/or one or more (e.g., about 1, 2, 3, 4, 5, 6, 7, 8, 9, 10, or more) 2'-deoxy, 2'-O-methyl, 2'-deoxy-2'-fluoro, and/or one or more (e.g., about 1, 2, 3, 4, 5, 6, 7, 8, 9, 10, or more) universal base modified nucleotides, and optionally a terminal cap molecule at the 3-end, the 5'-end, or both of the 3'- and 5'-ends of the sense strand; and in which the antisense strand comprises about 1 to about 25 or more (for example about 1, 2, 3, 4, 5, 6, 7, 8, 9, 10, 11, 12, 13, 14, 15, 16, 17, 18, 19, 20, or more) phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more (for example about 1, 2, 3, 4, 5, 6, 7, 8, 9, 10, or more) pyrimidine nucleotides of the sense and/or antisense strand are chemically-modified with 2'-deoxy, 2'-O-methyl and/or 2'-deoxy-2'-fluoro nucleotides, with or without about 1 to about 25 or more (for example about 1, 2, 3, 4, 5, 6, 7, 8, 9, 10, 11, 12, 13, 14, 15, 16, 17, 18, 19, 20, or more) phosphorothioate internucleotide linkages and/or a terminal cap molecule at the 3'-end, the 5'-end, or both of the 3'- and 5'-ends, being present in the same or different strand.

In some embodiments, a polynucleic acid molecule comprises a sense strand and an antisense strand, in which the antisense strand comprises one or more (for example, about 1, 2, 3, 4, 5, 6, 7, 8, 9, 10, 11, 12, 13, 14, 15, 16, 17, 18, 19, 20, or more) phosphorothioate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10 or more, phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more (for example about 1, 2, 3, 4, 5, 6, 7, 8, 9, 10, 11, 12, 13, 14, 15, 16, 17, 18, 19, 20, or more) pyrimidine nucleotides of the sense and/or antisense strand are chemically-modified with 2'-deoxy, 2'-O-methyl and/or 2'-deoxy-2'-fluoro nucleotides, with or without one or more (for example, about 1, 2, 3, 4, 5, 6, 7, 8, 9, 10 or more) phosphorothioate internucleotide linkages and/or a terminal cap molecule at the 3'-end, the 5'-end, or both of the 3' and 5'-ends, being present in the same or different strand.

In some embodiments, a polynucleic acid molecule comprises a sense strand and an antisense strand, in which the antisense strand comprises about 1 to about 25 or more (for example, about 1, 2, 3, 4, 5, 6, 7, 8, 9, 10, 11, 12, 13, 14, 15, 16, 17, 18, 19, 20, or more) phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 25 or more (for example about 1, 2, 3, 4, 5, 6, 7, 8, 9, 10, 11, 12, 13, 14, 15, 16, 17, 18, 19, 20, or more) phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more (for example about 1, 2, 3, 4, 5, 6, 7, 8, 9, 10 or more) pyrimidine nucleotides of the sense and/or antisense strand are chemically-modified with 2'-deoxy, 2'-O-methyl and/or 2'-deoxy-2'-fluoro nucleotides, with or without about 1 to about 5 (for example about 1, 2, 3, 4, 5 or more) phosphorothioate internucleotide linkages and/or a terminal cap molecule at the 3'-end, the 5'-end, or both of the 3'- and 5'-ends, being present in the same or different strand.

In some embodiments, a polynucleic acid molecule described herein is a chemically-modified short interfering nucleic acid molecule having about 1 to about 25 (for example, about 1, 2, 3, 4, 5, 6, 7, 8, 9, 10, 11, 12, 13, 14, 15, 16, 17, 18, 19, 20 or more) phosphorothioate internucleotide linkages in each strand of the polynucleic acid molecule.

In another embodiment, a polynucleic acid molecule described herein comprises 2'-5' internucleotide linkages. In some instances, the 2'-5' internucleotide linkage(s) is at the 3'-end, the 5'-end, or both of the 3'- and 5'-ends of one or both sequence strands. In addition instances, the 2'-5' internucleotide linkage(s) is present at various other positions within one or both sequence strands (for example, about 1, 2, 3, 4, 5, 6, 7, 8, 9, 10, or more) including every internucleotide linkage of a pyrimidine nucleotide in one or both strands of the polynucleic acid molecule comprise a 2'-5' internucleotide linkage, or about 1, 2, 3, 4, 5, 6, 7, 8, 9, 10, or more, including every internucleotide linkage of a purine nucleotide in one or both strands of the polynucleic acid molecule comprise a 2'-5' internucleotide linkage.

In some embodiments, a polynucleic acid molecule is a single stranded polynucleic acid molecule that mediates RNAi activity in a cell or reconstituted in vitro system, wherein the polynucleic acid molecule comprises a single stranded polynucleotide having complementarity to a target nucleic acid sequence, and wherein one or more pyrimidine nucleotides present in the polynucleic acid are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein one or more purine nucleotides present in the polynucleic acid are 2'-deoxy purine nucleotides (e.g., wherein all purine nucleotides are 2'-deoxy purine nucleotides or alternately a plurality of purine nucleotides are 2'-deoxy purine nucleotides), and a terminal cap modification, that is optionally present at the 3'-end, the 5'-end, or both of the 3' and 5'-ends of the antisense sequence, the polynucleic acid molecule optionally further comprising about 1 to about 4 (e.g., about 1, 2, 3, or 4) terminal 2'-deoxynucleotides at the 3'-end of the polynucleic acid molecule, wherein the terminal nucleotides further comprise one or more (e.g., 1, 2, 3, or 4) phosphorothioate internucleotide linkages, and wherein the polynucleic acid molecule optionally further comprises a terminal phosphate group, such as a 5'-terminal phosphate group.

In some cases, one or more artificial nucleotide analogues described herein are resistant toward nucleases such as for example ribonuclease such as RNase H, deoxyribunuclease such as DNase, or exonuclease such as 5'-3' exonuclease and 3'-5' exonuclease, when compared to natural polynucleic acid molecules. In some instances, artificial nucleotide analogues comprising 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or combinations thereof are resistant toward nucleases such as for example ribonuclease such as RNase H, deoxyribunuclease such as DNase, or exonuclease such as 5'-3' exonuclease and 3'-5' exonuclease. In some instances, 2'-O-methyl modified polynucleic acid molecule is nuclease resistant (e.g., RNase H, DNase, 5'-3' exonuclease or 3'-5' exonuclease resistant). In some instances, 2'O-methoxyethyl (2'-O-MOE) modified polynucleic acid molecule is nuclease resistant (e.g., RNase H, DNase, 5'-3' exonuclease or 3'-5' exonuclease resistant). In some instances, 2'-O-aminopropyl modified polynucleic acid molecule is nuclease resistant (e.g., RNase H, DNase, 5'-3' exonuclease or 3'-5' exonuclease resistant). In some instances, 2'-deoxy modified polynucleic acid molecule is nuclease resistant (e.g., RNase H, DNase, 5'-3' exonuclease or 3'-5' exonuclease resistant). In some instances, T-deoxy-2'-fluoro modified polynucleic acid molecule is nuclease resistant (e.g., RNase H, DNase, 5'-3' exonuclease or 3'-5' exonuclease resistant). In some instances, 2'-O-aminopropyl (2'-O-AP) modified polynucleic acid molecule is nuclease resistant (e.g., RNase H, DNase, 5'-3' exonuclease or 3'-5' exonuclease resistant). In some instances, 2'-O-dimethylaminoethyl (2'-O-DMAOE) modified polynucleic acid molecule is nuclease resistant (e.g., RNase H, DNase, 5'-3' exonuclease or 3'-5' exonuclease resistant). In some instances, 2'-O-dimethylaminopropyl (2'-O-DMAP) modified polynucleic acid molecule is nuclease resistant (e.g., RNase H, DNase, 5'-3' exonuclease or 3'-5' exonuclease resistant). In some instances, T-O-dimethylaminoethyloxyethyl (2'-O-DMAEOE) modified polynucleic acid molecule is nuclease resistant (e.g., RNase H, DNase, 5'-3' exonuclease or 3'-5' exonuclease resistant). In some instances, 2'-O—N-methylacetamido (2'-O-NMA) modified polynucleic acid molecule is nuclease resistant (e.g., RNase H, DNase, 5'-3' exonuclease or 3'-5' exonuclease resistant). In some instances, LNA modified polynucleic acid molecule is nuclease resistant (e.g., RNase H, DNase, 5'-3' exonuclease or 3'-5' exonuclease resistant). In some instances, ENA modified polynucleic acid molecule is nuclease resistant (e.g., RNase H, DNase, 5'-3' exonuclease or 3'-5' exonuclease resistant). In some instances, HNA modified polynucleic acid molecule is nuclease resistant (e.g., RNase H, DNase, 5'-3' exonuclease or 3'-5' exonuclease resistant). In some instances, morpholinos is nuclease resistant (e.g., RNase H, DNase, 5'-3' exonuclease or 3'-5' exonuclease resistant). In some instances, PNA modified polynucleic acid molecule is resistant to nucleases (e.g., RNase H, DNase, 5'-3' exonuclease or 3'-5' exonuclease resistant). In some instances, methylphosphonate nucleotides modified polynucleic acid molecule is nuclease resistant (e.g., RNase H, DNase, 5'-3' exonuclease or 3'-5' exonuclease resistant). In some instances, thiolphosphonate nucleotides modified polynucleic acid molecule is nuclease resistant (e.g., RNase H, DNase, 5'-3' exonuclease or 3'-5' exonuclease resistant). In some instances, polynucleic acid molecule comprising 2'-fluoro N3-P5'-phosphoramidites is nuclease resistant (e.g., RNase H, DNase, 5'-3' exonuclease or 3'-5' exonuclease resistant). In some instances, the 5' conjugates described herein inhibit 5'-3' exonucleolytic cleavage. In some instances, the 3' conjugates described herein inhibit exonucleolytic cleavage.

In some embodiments, one or more of the artificial nucleotide analogues described herein have increased binding affinity toward their mRNA target relative to an equivalent natural polynucleic acid molecule. The one or more of the artificial nucleotide analogues comprising 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, or 2'-fluoro N3-P5'-phosphoramidites have increased binding affinity toward their mRNA target relative to an equivalent natural polynucleic acid molecule. In some instances, 2'-O-methyl-modified polynucleic acid molecule has increased binding affinity toward their mRNA target relative to an equivalent natural polynucleic acid molecule. In some instances, 2'-O-methoxyethyl (2'-O-MOE) modified polynucleic acid molecule has increased binding affinity toward their mRNA target relative to an equivalent natural polynucleic acid molecule. In some instances, 2'-O-aminopropyl modified polynucleic acid molecule has increased binding affinity toward their mRNA target relative to an equivalent natural polynucleic acid molecule. In some instances, 2'-deoxy modified polynucleic acid molecule has increased binding affinity toward their mRNA target relative to an equivalent natural polynucleic acid molecule. In some instances, T-deoxy-2'-fluoro modified polynucleic acid molecule has increased binding affinity toward their mRNA target relative to an equivalent natural polynucleic acid molecule. In some instances, 2'-O-aminopropyl (2'-O-AP) modified polynucleic acid molecule has increased binding affinity toward their mRNA target relative to an equivalent natural polynucleic acid molecule. In some instances, 2'-O-dimethylaminoethyl (2'-O-DMAOE) modified polynucleic acid molecule has increased binding affinity toward their mRNA target relative to an equivalent natural polynucleic acid molecule. In some instances, 2'-O-dimethylaminopropyl (2'-O-DMAP) modified polynucleic acid molecule has increased binding affinity toward their mRNA target relative to an equivalent natural polynucleic acid molecule. In some instances, T-O-dimethylaminoethyloxyethyl (2'-O-DMAEOE) modified polynucleic acid molecule has increased binding affinity toward their mRNA target relative to an equivalent natural polynucleic acid molecule. In some instances, 2'-O—N-methylacetamido (2'-O-NMA) modified polynucleic acid molecule has increased binding affinity toward their mRNA target relative to an equivalent natural polynucleic acid molecule. In some instances, LNA-modified polynucleic acid molecule has increased binding affinity toward their mRNA target relative to an equivalent natural polynucleic acid molecule. In some instances, ENA-modified polynucleic acid molecule has increased binding affinity toward their mRNA target relative to an equivalent natural polynucleic acid molecule. In some instances, PNA-modified polynucleic acid molecule has increased binding affinity toward their mRNA target relative to an equivalent natural polynucleic acid molecule. In some instances, HNA-modified polynucleic acid molecule has increased binding affinity toward their mRNA target relative to an equivalent natural polynucleic acid molecule. In some instances, morpholino-modified polynucleic acid molecule has increased binding affinity toward their mRNA target relative to an equivalent natural polynucleic acid molecule. In some instances, methylphosphonate nucleotide-modified polynucleic acid molecule has increased binding affinity toward their mRNA target relative to an equivalent natural polynucleic acid molecule. In some instances, thiolphosphonate nucleotide-modified polynucleic acid molecule has increased binding affinity toward their mRNA target relative to an equivalent natural polynucleic acid molecule. In some instances, polynucleic acid molecule comprising 2'-fluoro N3-P5'-phosphoramidites has increased binding affinity toward their mRNA target relative to an equivalent natural polynucleic acid molecule. In some cases, the increased affinity is illustrated with a lower Kd, a higher melt temperature (Tm), or a combination thereof.

In some embodiments, a polynucleic acid molecule described herein is a chirally pure (or stereo pure) polynucleic acid molecule, or a polynucleic acid molecule comprising a single enantiomer. In some instances, the polynucleic acid molecule comprises L-nucleotide. In some instances, the polynucleic acid molecule comprises D-nucleotides. In some instance, a polynucleic acid molecule composition comprises less than 30%, 25%, 20%, 15%, 10%, 5%, 4%, 3%, 2%, 1%, or less of its mirror enantiomer. In some cases, a polynucleic acid molecule composition comprises less than 30%, 25%, 20%, 15%, 10%, 5%, 4%, 3%, 2%, 1%, or less of a racemic mixture. In some instances, the polynucleic acid molecule is a polynucleic acid molecule described in: U.S. Patent Publication Nos: 2014/194610 and 2015/211006; and PCT Publication No.: WO2015107425.

In some embodiments, a polynucleic acid molecule described herein is further modified to include an aptamer-conjugating moiety. In some instances, the aptamer conjugating moiety is a DNA aptamer-conjugating moiety. In some instances, the aptamer-conjugating moiety is Alphamer (Centauri Therapeutics), which comprises an aptamer portion that recognizes a specific cell-surface target and a portion that presents a specific epitopes for attaching to circulating antibodies. In some instance, a polynucleic acid molecule described herein is further modified to include an aptamer-conjugating moiety as described in: U.S. Pat. Nos. 8,604,184, 8,591,910, and 7,850,975.

In additional embodiments, a polynucleic acid molecule described herein is modified to increase its stability. In some embodiment, the polynucleic acid molecule is RNA (e.g., siRNA), and the polynucleic acid molecule is modified to increase its stability. In some instances, the polynucleic acid molecule is modified by one or more of the modifications described above to increase its stability. In some cases, the polynucleic acid molecule is modified at the 2' hydroxyl position, such as by 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modification or by a locked or bridged ribose conformation (e.g., LNA or ENA). In some cases, the polynucleic acid molecule is modified by 2'-O-methyl and/or 2'-O-methoxyethyl ribose. In some cases, the polynucleic acid molecule also includes morpholinos, PNAs, HNA, methylphosphonate nucleotides, thiolphosphonate nucleotides, and/or 2'-fluoro N3-P5'-phosphoramidites to increase its stability. In some instances, the polynucleic acid molecule is a chirally pure (or stereo pure) polynucleic acid molecule. In some instances, the chirally pure (or stereo pure) polynucleic acid molecule is modified to increase its stability. Suitable modifications to the RNA to increase stability for delivery will be apparent to the skilled person.

In some embodiments, a polynucleic acid molecule describe herein has RNAi activity that modulates expression of RNA encoded by EGFR. In some instances, a polynucleic acid molecule described herein is a double-stranded siRNA molecule that down-regulates expression of EGFR, wherein one of the strands of the double-stranded siRNA molecule comprises a nucleotide sequence that is complementary to a nucleotide sequence of EGFR or RNA encoded by EGFR or a portion thereof, and wherein the second strand of the double-stranded siRNA molecule comprises a nucleotide sequence substantially similar to the nucleotide sequence of EGFR or RNA encoded by EGFR or a portion thereof. In some cases, a polynucleic acid molecule described herein is a double-stranded siRNA molecule that down-regulates expression of EGFR, wherein each strand of the siRNA molecule comprises about 15 to 25, 18 to 24, or 19 to about 23 nucleotides, and wherein each strand comprises at least about 14, 17, or 19 nucleotides that are complementary to the nucleotides of the other strand. In some cases, a polynucleic acid molecule described herein is a double-stranded siRNA molecule that down-regulates expression of EGFR, wherein each strand of the siRNA molecule comprises about 19 to about 23 nucleotides, and wherein each strand comprises at least about 19 nucleotides that are complementary to the nucleotides of the other strand. In some instances, the RNAi activity occurs within a cell. In other instances, the RNAi activity occurs in a reconstituted in vitro system.

In some embodiments, a polynucleic acid molecule describe herein has RNAi activity that modulates expression of RNA encoded by EGFR. In some instances, a polynucleic acid molecule described herein is a single-stranded siRNA molecule that down-regulates expression of EGFR, wherein the single-stranded siRNA molecule comprises a nucleotide sequence that is complementary to a nucleotide sequence of EGFR or RNA encoded by EGFR or a portion thereof. In some cases, a polynucleic acid molecule described herein is a single-stranded siRNA molecule that down-regulates expression of EGFR, wherein the siRNA molecule comprises about 15 to 25, 18 to 24, or 19 to about 23 nucleotides. In some cases, a polynucleic acid molecule described herein is a single-stranded siRNA molecule that down-regulates expression of EGFR, wherein the siRNA molecule comprises about 19 to about 23 nucleotides. In some instances, the RNAi activity occurs within a cell. In other instances, the RNAi activity occurs in a reconstituted in vitro system.

In some instances, a polynucleic acid molecule is a double-stranded polynucleotide molecule comprising self-complementary sense and antisense regions, wherein the antisense region comprises a nucleotide sequence that is complementary to a nucleotide sequence in a target nucleic acid molecule or a portion thereof and the sense region has a nucleotide sequence corresponding to the target nucleic acid sequence or a portion thereof. In some instances, the polynucleic acid molecule is assembled from two separate polynucleotides, where one strand is the sense strand and the other is the antisense strand, wherein the antisense and sense strands are self-complementary (e.g., each strand comprises a nucleotide sequence that is complementary to the nucleotide sequence in the other strand; such as where the antisense strand and sense strand form a duplex or double-stranded structure, for example wherein the double-stranded region is about 19, 20, 21, 22, 23, or more base pairs); the antisense strand comprises a nucleotide sequence that is complementary to a nucleotide sequence in a target nucleic acid molecule or a portion thereof and the sense strand comprises a nucleotide sequence corresponding to the target nucleic acid sequence or a portion thereof. Alternatively, the polynucleic acid molecule is assembled from a single oligonucleotide, where the self-complementary sense and antisense regions of the polynucleic acid molecule are linked by means of a nucleic acid based or non-nucleic acid-based linker(s).

In some cases, a polynucleic acid molecule is a polynucleotide with a duplex, asymmetric duplex, hairpin, or asymmetric hairpin secondary structure, having self-complementary sense and antisense regions, wherein the antisense region comprises a nucleotide sequence that is complementary to a nucleotide sequence in a separate target nucleic acid molecule or a portion thereof and the sense region has a nucleotide sequence corresponding to the target nucleic acid sequence or a portion thereof. In other cases, the polynucleic acid molecule is a circular single-stranded polynucleotide having two or more loop structures and a stem comprising self-complementary sense and antisense regions, wherein the antisense region comprises a nucleotide sequence that is complementary to a nucleotide sequence in a target nucleic acid molecule or a portion thereof and the sense region has a nucleotide sequence corresponding to the target nucleic acid sequence or a portion thereof, and wherein the circular polynucleotide is processed either in vivo or in vitro to generate an active polynucleic acid molecule capable of mediating RNAi. In additional cases, the polynucleic acid molecule also comprises a single-stranded polynucleotide having a nucleotide sequence complementary to a nucleotide sequence in a target nucleic acid molecule or a portion thereof (for example, where such polynucleic acid molecule does not require the presence within the polynucleic acid molecule of a nucleotide sequence corresponding to the target nucleic acid sequence or a portion thereof), wherein the single stranded polynucleotide further comprises a terminal phosphate group, such as a 5'-phosphate (see for example Martinez et al., 2002, *Cell.*, 110, 563-574 and Schwarz et al., 2002, *Molecular Cell*, 10, 537-568), or 5',3'-diphosphate.

In some instances, an asymmetric duplex is a linear polynucleic acid molecule comprising an antisense region, a loop portion that comprises nucleotides or non-nucleotides, and a sense region that comprises fewer nucleotides than the antisense region to the extent that the sense region has enough complimentary nucleotides to base pair with the antisense region and form a duplex with loop. For example, an asymmetric hairpin polynucleic acid molecule comprises an antisense region having length sufficient to mediate RNAi in a cell or in vitro system (e.g. about 19 to about 22 nucleotides) and a loop region comprising about 4 to about 8 nucleotides, and a sense region having about 3 to about 18 nucleotides that are complementary to the antisense region. In some cases, the asymmetric hairpin polynucleic acid molecule also comprises a 5'-terminal phosphate group that is chemically modified. In additional cases, the loop portion of the asymmetric hairpin polynucleic acid molecule comprises nucleotides, non-nucleotides, linker molecules, or conjugate molecules.

In some embodiments, an asymmetric duplex is a polynucleic acid molecule having two separate strands comprising a sense region and an antisense region, wherein the sense region comprises fewer nucleotides than the antisense region to the extent that the sense region has enough complimentary nucleotides to base pair with the antisense region and form a duplex. For example, an asymmetric duplex polynucleic acid molecule comprises an antisense region having length sufficient to mediate RNAi in a cell or in vitro system (e.g. about 19 to about 22 nucleotides) and a sense region having about 3 to about 18 nucleotides that are complementary to the antisense region.

In some cases, a universal base refers to nucleotide base analogs that form base pain with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole 5-nitroindole, and 6-nitroindole as known in the art (see for example Loakes, 2001, *Nucleic Acids Research*, 29, 2437-2447).

Polynucleic Acid Molecule Synthesis

In some embodiments, a polynucleic acid molecule described herein is constructed using chemical synthesis and/or enzymatic ligation reactions using procedures known in the art. For example, a polynucleic acid molecule is chemically synthesized using naturally occurring nucleotides or variously modified nucleotides designed to increase the biological stability of the molecules or to increase the physical stability of the duplex formed between the polynucleic acid molecule and target nucleic acids. Exemplary methods include those described in: U.S. Pat. Nos. 5,142,047; 5,185,444; 5,889,136; 6,008,400; and 6,111,086; PCT Publication No. WO2009099942; or European Publication No. 1579015. Additional exemplary methods include those described in: Griffey et al., "2'-O-aminopropyl ribonucleotides: a zwitterionic modification that enhances the exonuclease resistance and biological activity of antisense oligonucleotides," *J. Med. Chem.* 39(26):5100-5109 (1997)); Obika, et al. "Synthesis of 2'-O,4'-C-methyleneuridine and -cytidine. Novel bicyclic nucleosides having a fixed C3, -endo sugar puckering". *Tetrahedron Letters* 38 (50): 8735 (1997); Koizumi, M. "ENA oligonucleotides as therapeutics". *Current opinion in molecular therapeutics* 8 (2): 144-149 (2006); and Abramova et al., "Novel oligonucleotide analogues based on morpholino nucleoside subunits-antisense technologies: new chemical possibilities," Indian Journal of Chemistry 48B:1721-1726 (2009). Alternatively, the polynucleic acid molecule is produced biologically using an expression vector into which a polynucleic acid molecule has been subcloned in an antisense orientation (i.e., RNA transcribed from the inserted polynucleic acid molecule will be of an antisense orientation to a target polynucleic acid molecule of interest).

In some embodiments, a polynucleic acid molecule is synthesized via a tandem synthesis methodology, wherein both strands are synthesized as a single contiguous oligonucleotide fragment or strand separated by a cleavable linker which is subsequently cleaved to provide separate fragments or strands that hybridize and permit purification of the duplex.

In some instances, a polynucleic acid molecule is also assembled from two distinct nucleic acid strands or fragments wherein one fragment includes the sense region and the second fragment includes the antisense region of the molecule.

Additional modification methods for incorporating, for example, sugar, base, and phosphate modifications include: Eckstein et al., International Publication PCT No. WO 92/07065; Perrault et al. *Nature*, 1990, 344, 565-568; Pieken et al. *Science*, 1991, 253, 314-317; Usman and Cedergren, *Trends in Biochem. Sci.*, 1992, 17, 334-339; Usman et al. International Publication PCT No. WO 93/15187; Sproat, U.S. Pat. No. 5,334,711 and Beigelman et al., 1995, *J. Biol. Chem.*, 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.*, 39, 1131; Earnshaw and Gait, 1998, *Biopolymers* (*Nucleic Acid Sciences*), 48, 39-55; Verma and Eckstein, 1998, *Annu. Rev. Biochem.*, 67, 99-134; and Burlina et al., 1997, *Bioorg. Med. Chem.*, 5, 1999-2010. Such publications describe general methods and strategies to determine the location of incorporation of sugar, base, and/or phosphate modifications and the like into nucleic acid molecules without modulating catalysis.

In some instances, while chemical modification of the polynucleic acid molecule internucleotide linkages with phosphorothioate, phosphorodithioate, and/or 5'-methylphosphonate linkages improves stability, excessive modifications sometimes cause toxicity or decreased activity. Therefore, when designing nucleic acid molecules, the amount of these internucleotide linkages in some cases is minimized. In such cases, the reduction in the concentration of these linkages lowers toxicity, and increases efficacy and specificity of these molecules.

Diseases

In some embodiments, a polynucleic acid molecule or a pharmaceutical composition described herein is used for the treatment of a disease or disorder. In some instances, the disease or disorder is a cancer. In some embodiments, a polynucleic acid molecule or a pharmaceutical composition described herein is used for the treatment of cancer. In some instances, the cancer is a solid tumor. In some instances, the cancer is a hematologic malignancy. In some instances, the cancer is a relapsed or refractory cancer, or a metastatic cancer. In some instances, the solid tumor is a relapsed or refractory solid tumor, or a metastatic solid tumor. In some cases, the hematologic malignancy is a relapsed or refractory hematologic malignancy, or a metastatic hematologic malignancy.

In some embodiments, the cancer is a solid tumor. Exemplary solid tumor includes, but is not limited to, anal cancer, appendix cancer, bile duct cancer (i.e., cholangiocarcinoma), bladder cancer, brain tumor, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer.

In some instances, a polynucleic acid molecule or a pharmaceutical composition described herein is used for the treatment of a solid tumor. In some instances, a polynucleic acid molecule or a pharmaceutical composition described herein is used for the treatment of anal cancer, appendix cancer, bile duct cancer (i.e., cholangiocarcinoma), bladder cancer, brain tumor, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer. In some instances, the solid tumor is a relapsed or refractory solid tumor, or a metastatic solid tumor.

In some instances, the cancer is a hematologic malignancy. In some instances, the hematologic malignancy is a leukemia, a lymphoma, a myeloma, a non-Hodgkin's lymphoma, or a Hodgkin's lymphoma. In some instances, the hematologic malignancy comprises chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenström's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis.

In some instances, a polynucleic acid molecule or a pharmaceutical composition described herein is used for the treatment of a hematologic malignancy. In some instances, a polynucleic acid molecule or a pharmaceutical composition described herein is used for the treatment of a leukemia, a lymphoma, a myeloma, a non-Hodgkin's lymphoma, or a Hodgkin's lymphoma. In some instances, the hematologic malignancy comprises chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenström's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis. In some cases, the hematologic malignancy is a relapsed or refractory hematologic malignancy, or a metastatic hematologic malignancy.

In some instances, the cancer is an EGFR-associated cancer. In some instances, a polynucleic acid molecule or a pharmaceutical composition described herein is used for the treatment of an EGFR-associated cancer. In some instances, the cancer is a solid tumor. In some instances, the cancer is a hematologic malignancy. In some instances, the solid tumor is a relapsed or refractory solid tumor, or a metastatic solid tumor. In some cases, the hematologic malignancy is a relapsed or refractory hematologic malignancy, or a metastatic hematologic malignancy. In some instances, the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, thyroid cancer, acute myeloid leukemia, CLL, DLBCL, or multiple myeloma.

Pharmaceutical Formulation

In some embodiments, the pharmaceutical formulations described herein are administered to a subject by multiple administration routes including, but not limited to, parenteral (e.g., intravenous, subcutaneous, intramuscular), oral, intranasal, buccal, rectal, or transdermal administration routes. In some instances, the pharmaceutical composition describe herein is formulated for parenteral (e.g., intravenous, subcutaneous, intramuscular) administration. In other instances, the pharmaceutical composition describe herein is formulated for oral administration. In still other instances, the pharmaceutical composition describe herein is formulated for intranasal administration.

In some embodiments, the pharmaceutical formulations include, but are not limited to, aqueous liquid dispersions, self-emulsifying dispersions, solid solutions, liposomal dispersions, aerosols, solid dosage forms, powders, immediate release formulations, controlled release formulations, fast melt formulations, tablets, capsules, pills, delayed release formulations, extended release formulations, pulsatile release formulations, multiparticulate formulations (e.g., nanoparticle formulations), and mixed immediate- and controlled-release formulations.

In some instances, the pharmaceutical formulation includes multiparticulate formulations. In some instances, the pharmaceutical formulation includes nanoparticle formulations. In some instances, nanoparticles comprise cMAP, cyclodextrin, or lipids. In some cases, nanoparticles comprise solid lipid nanoparticles, polymeric nanoparticles, self-emulsifying nanoparticles, liposomes, microemulsions, or micellar solutions. Additional exemplary nanoparticles include, but are not limited to, paramagnetic nanoparticles, superparamagnetic nanoparticles, metal nanoparticles, fullerene-like materials, inorganic nanotubes, dendrimers (such as with covalently attached metal chelates), nanofibers, nanohorns, nano-onions, nanorods, nanoropes, and quantum dots. In some instances, a nanoparticle is a metal nanoparticle, e.g., a nanoparticle of scandium, titanium, vanadium, chromium, manganese, iron, cobalt, nickel, copper, zinc, yttrium, zirconium, niobium, molybdenum, ruthenium, rhodium, palladium, silver, cadmium, hafnium, tantalum, tungsten, rhenium, osmium, iridium, platinum, gold, gadolinium, aluminum, gallium, indium, tin, thallium, lead, bismuth, magnesium, calcium, strontium, barium, lithium, sodium, potassium, boron, silicon, phosphorus, germanium, arsenic, antimony, and combinations, alloys, or oxides thereof.

In some instances, a nanoparticle includes a core or a core and a shell, as in a core-shell nanoparticle.

In some instances, a nanoparticle is further coated with molecules for attachment of functional elements (e.g., with one or more of a polynucleic acid molecule or binding moiety described herein). In some instances, a coating comprises chondroitin sulfate, dextran sulfate, carboxymethyl dextran, alginic acid, pectin, carragheenan, fucoidan, agaropectin, porphyran, karaya gum, gellan gum, xanthan gum, hyaluronic acids, glucosamine, galactosamine, chitin (or chitosan), polyglutamic acid, polyaspartic acid, lysozyme, cytochrome C, ribonuclease, trypsinogen, chymotrypsinogen, α-chymotrypsin, polylysine, polyarginine, histone, protamine, ovalbumin, dextrin, or cyclodextrin. In some instances, a nanoparticle comprises a graphene-coated nanoparticle.

In some cases, a nanoparticle has at least one dimension of less than about 500 nm, 400 nm, 300 nm, 200 nm, or 100 nm.

In some instances, the nanoparticle formulation comprises paramagnetic nanoparticles, superparamagnetic nanoparticles, metal nanoparticles, fullerene-like materials, inorganic nanotubes, dendrimers (such as with covalently attached metal chelates), nanofibers, nanohorns, nano-onions, nanorods, nanoropes or quantum dots. In some instances, a polynucleic acid molecule or a binding moiety described herein is conjugated either directly or indirectly to the nanoparticle. In some instances, at least 1, 5, 10, 15, 20, 30, 40, 50, 60, 70, 80, 90, 100 or more polynucleic acid molecules or binding moieties described herein are conjugated either directly or indirectly to a nanoparticle.

In some embodiments, the pharmaceutical formulation comprise a delivery vector, e.g., a recombinant vector, for the delivery of the polynucleic acid molecule into cells. In some instances, the recombinant vector is DNA plasmid. In other instances, the recombinant vector is a viral vector. Exemplary viral vectors include vectors derived from adeno-associated virus, retrovirus, adenovirus, or alphavirus. In some instances, the recombinant vectors capable of expressing the polynucleic acid molecules provide stable expression in target cells. In additional instances, viral vectors are used that provide for transient expression of polynucleic acid molecules.

In some embodiments, the pharmaceutical formulations include a carrier or carrier materials selected on the basis of compatibility with the composition disclosed herein, and the release profile properties of the desired dosage form. Exemplary carrier materials include, e.g., binders, suspending agents, disintegration agents, filling agents, surfactants, solubilizers, stabilizers, lubricants, wetting agents, diluents, and the like. Pharmaceutically compatible carrier materials include, but are not limited to, acacia, gelatin, colloidal silicon dioxide, calcium glycerophosphate, calcium lactate, maltodextrin, glycerine, magnesium silicate, polyvinylpyrrollidone (PVP), cholesterol, cholesterol esters, sodium caseinate, soy lecithin, taurocholic acid, phosphotidylcholine, sodium chloride, tricalcium phosphate, dipotassium phosphate, cellulose and cellulose conjugates, sugars sodium stearoyl lactylate, carrageenan, monoglyceride, diglyceride, pregelatinized starch, and the like. See, e.g., *Remington: The Science and Practice of Pharmacy*, Nineteenth Ed (Easton, Pa.: Mack Publishing Company, 1995); Hoover, John E., *Remington's Pharmaceutical Sciences*, Mack Publishing Co., Easton, Pa. 1975; Liberman, H. A. and Lachman, L., Eds., *Pharmaceutical Dosage Forms*, Marcel Decker, New York, N.Y., 1980; and *Pharmaceutical Dosage Forms and Drug Delivery Systems*, Seventh Ed. (Lippincott Williams & Wilkins 1999).

In some instances, the pharmaceutical formulations further include pH-adjusting agents or buffering agents which include acids such as acetic, boric, citric, lactic, phosphoric and hydrochloric acids; bases such as sodium hydroxide, sodium phosphate, sodium borate, sodium citrate, sodium acetate, sodium lactate and tris-hydroxymethylaminomethane; and buffers such as citrate/dextrose, sodium bicarbonate, and ammonium chloride. Such acids, bases and buffers are included in an amount required to maintain pH of the composition in an acceptable range.

In some instances, the pharmaceutical formulation includes one or more salts in an amount required to bring osmolality of the composition into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

In some instances, the pharmaceutical formulations further include diluent which are used to stabilize compounds because they provide a more stable environment. Salts dissolved in buffered solutions (which also provide pH control or maintenance) are utilized as diluents in the art, including, but not limited to a phosphate-buffered saline solution. In certain instances, diluents increase bulk of the composition to facilitate compression or create sufficient bulk for homogenous blend for capsule filling. Such compounds include e.g., lactose, starch, mannitol, sorbitol, dextrose, microcrystalline cellulose such as Avicel®; dibasic calcium phosphate, dicalcium phosphate dihydrate; tricalcium phosphate, calcium phosphate; anhydrous lactose, spray-dried lactose; pregelatinized starch, compressible sugar, such as Di-Pac® (Amstar); mannitol, hydroxypropylmethylcellulose, hydroxypropylmethylcellulose acetate stearate, sucrose-based diluents, confectioner's sugar; monobasic calcium sulfate monohydrate, calcium sulfate dihydrate; calcium lactate trihydrate, dextrates; hydrolyzed cereal solids, amylose; powdered cellulose, calcium carbonate; glycine, kaolin; mannitol, sodium chloride; inositol, bentonite, and the like.

In some cases, the pharmaceutical formulations include disintegration agents or disintegrants to facilitate the breakup or disintegration of a substance. The term "disintegrate" includes both the dissolution and dispersion of the dosage form when contacted with gastrointestinal fluid. Examples of disintegration agents include a starch, e.g., a natural starch such as corn starch or potato starch, a pregelatinized starch such as National 1551 or Amijel®, or sodium starch glycolate such as Promogel® or Explotab®; a cellulose such as a wood product, methylcrystalline cellulose, e.g., Avicel®, Avicel® PH101, Avicel® PH102, Avicel® PH105, Elcema® P100, Emcocel®, Vivacel®, Ming Tia®, and Solka-Floc®, methylcellulose, croscarmellose, or a cross-linked cellulose, such as cross-linked sodium carboxymethylcellulose (Ac-Di-Sol®), cross-linked carboxymethylcellulose, or cross-linked croscarmellose; a cross-linked starch such as sodium starch glycolate, a cross-linked polymer such as crospovidone; a cross-linked polyvinylpyrrolidone, alginate such as alginic acid or a salt of alginic acid such as sodium alginate, a clay such as Veegum® HV (magnesium aluminum silicate); a gum such as agar, guar, locust bean, Karaya, pectin, or tragacanth; sodium starch glycolate; bentonite; a natural sponge; a surfactant; a resin such as a cation-exchange resin; citrus pulp; sodium lauryl sulfate; sodium lauryl sulfate in combination starch; and the like.

In some instances, the pharmaceutical formulations include filling agents such as lactose, calcium carbonate, calcium phosphate, dibasic calcium phosphate, calcium sulfate, microcrystalline cellulose, cellulose powder, dextrose, dextrates, dextran, starches, pregelatinized starch, sucrose, xylitol, lactitol, mannitol, sorbitol, sodium chloride, polyethylene glycol, and the like.

Lubricants and glidants are also optionally included in the pharmaceutical formulations described herein for preventing, reducing, or inhibiting adhesion or friction of materials. Exemplary lubricants include, e.g., stearic acid, calcium hydroxide, talc, sodium stearyl fumerate, a hydrocarbon such as mineral oil, or hydrogenated vegetable oil such as hydrogenated soybean oil (Sterotex®), higher fatty acids and their alkali-metal and alkaline earth metal salts, such as aluminum, calcium, magnesium, zinc, stearic acid, sodium stearates, glycerol, talc, waxes, Stearowet®, boric acid, sodium benzoate, sodium acetate, sodium chloride, leucine, a polyethylene glycol (e.g., PEG-4000) or a methoxypolyethylene glycol such as Carbowax™ sodium oleate, sodium benzoate, glyceryl behenate, polyethylene glycol, magnesium or sodium lauryl sulfate, colloidal silica such as Syloid™, Cab-O-Sil®, a starch such as corn starch, silicone oil, a surfactant, and the like.

Plasticizers include compounds used to soften the microencapsulation material or film coatings to make them less brittle. Suitable plasticizers include, e.g., polyethylene glycols such as PEG 300, PEG 400, PEG 600, PEG 1450, PEG 3350, and PEG 800, stearic acid, propylene glycol, oleic acid, triethyl cellulose and triacetin. Plasticizers also function as dispersing agents or wetting agents.

Solubilizers include compounds such as triacetin, triethylcitrate, ethyl oleate, ethyl caprylate, sodium lauryl sulfate, sodium doccusate, vitamin E TPGS, dimethylacetamide, N-methylpyrrolidone, N-hydroxyethylpyrrolidone, polyvinylpyrrolidone, hydroxypropylmethyl cellulose, hydroxypropyl cyclodextrins, ethanol, n-butanol, isopropyl alcohol, cholesterol, bile salts, polyethylene glycol 200-600, glycofurol, transcutol, propylene glycol, dimethyl isosorbide, and the like.

Stabilizers include compounds such as any antioxidation agents, buffers, acids, preservatives, and the like.

Suspending agents include compounds such as polyvinylpyrrolidone (e.g., polyvinylpyrrolidone K12, polyvinylpyrrolidone K17, polyvinylpyrrolidone K25, or polyvinylpyrrolidone K30), vinyl pyrrolidone/vinyl acetate copolymer (S630), polyethylene glycol (e.g., the polyethylene glycol has a molecular weight of about 300 to about 6000, or about 3350 to about 4000, or about 7000 to about 5400), sodium carboxymethylcellulose, methylcellulose, hydroxypropylmethylcellulose, hydroxymethylcellulose acetate stearate, polysorbate-80, hydroxyethylcellulose, sodium alginate, gums (such as, e.g., gum tragacanth and gum acacia, guar gum, xanthans, including xanthan gum), sugars, cellulosics (such as, e.g., sodium carboxymethylcellulose, methylcellulose, sodium carboxymethylcellulose, hydroxypropylmethylcellulose, hydroxyethylcellulose), polysorbate-80, sodium alginate, polyethoxylated sorbitan monolaurate, polyethoxylated sorbitan monolaurate, povidone, and the like.

Surfactants include compounds such as sodium lauryl sulfate, sodium docusate, Tween 60 or 80, triacetin, vitamin E TPGS, sorbitan monooleate, polyoxyethylene sorbitan monooleate, polysorbates, polaxomers, bile salts, glyceryl monostearate, copolymers of ethylene oxide and propylene oxide, e.g., Pluronic® (BASF), and the like. Additional surfactants include polyoxyethylene fatty acid glycerides and vegetable oils, e.g., polyoxyethylene (60) hydrogenated castor oil; and polyoxyethylene alkylethers and alkylphenyl ethers, e.g., octoxynol 10, octoxynol 40. Sometimes, surfactants are included to enhance physical stability or for other purposes.

Viscosity enhancing agents include, e.g., methyl cellulose, xanthan gum, carboxymethyl cellulose, hydroxypropyl cellulose, hydroxypropylmethyl cellulose, hydroxypropylmethyl cellulose acetate stearate, hydroxypropylmethyl cellulose phthalate, carbomer, polyvinyl alcohol, alginates, acacia, chitosans, and combinations thereof.

Wetting agents include compounds such as oleic acid, glyceryl monostearate, sorbitan monooleate, sorbitan monolaurate, triethanolamine oleate, polyoxyethylene sorbitan monooleate, polyoxyethylene sorbitan monolaurate, sodium docusate, sodium oleate, sodium lauryl sulfate, sodium doccusate, triacetin, Tween 80, vitamin E TPGS, ammonium salts, and the like.

Therapeutic Regimens

In some embodiments, the pharmaceutical compositions described herein are administered for therapeutic applications. In some embodiments, the pharmaceutical composition is administered once per day, twice per day, three times per day, or more. The pharmaceutical composition is administered daily, every day, every alternate day, five days a week, once a week, every other week, two weeks per month, three weeks per month, once a month, twice a month, three times per month, or more. The pharmaceutical composition is administered for at least 1 month, 2 months, 3 months, 4 months, 5 months, 6 months, 7 months, 8 months, 9 months, 10 months, 11 months, 12 months, 18 months, 2 years, 3 years, or more.

In some embodiments, one or more pharmaceutical compositions are administered simultaneously, sequentially, or at an interval period of time. In some embodiments, one or more pharmaceutical compositions are administered simultaneously. In some cases, one or more pharmaceutical compositions are administered sequentially. In additional cases, one or more pharmaceutical compositions are administered at an interval period of time (e.g., the first administration of a first pharmaceutical composition is on day one followed by an interval of at least 1, 2, 3, 4, 5, or more days prior to the administration of at least a second pharmaceutical composition).

In some embodiments, two or more different pharmaceutical compositions are coadministered. In some instances, the two or more different pharmaceutical compositions are coadministered simultaneously. In some cases, the two or more different pharmaceutical compositions are coadministered sequentially without a gap of time between administrations. In other cases, the two or more different pharmaceutical compositions are coadministered sequentially with a gap of about 0.5 hour, 1 hour, 2 hour, 3 hour, 12 hours, 1 day, 2 days, or more between administrations.

In the case wherein the patient's status does improve, upon the doctor's discretion the administration of the composition is given continuously; alternatively, the dose of the composition being administered is temporarily reduced or temporarily suspended for a certain length of time (i.e., a "drug holiday"). In some instances, the length of the drug holiday varies between 2 days and 1 year, including by way of example only, 2 days, 3 days, 4 days, 5 days, 6 days, 7 days, 10 days, 12 days, 15 days, 20 days, 28 days, 35 days, 50 days, 70 days, 100 days, 120 days, 150 days, 180 days, 200 days, 250 days, 280 days, 300 days, 320 days, 350 days, or 365 days. The dose reduction during a drug holiday is from 10%-100%, including, by way of example only, 10%, 15%, 20%, 25%, 30%, 35%, 40%, 45%, 50%, 55%, 60%, 65%, 70%, 75%, 80%, 85%, 90%, 95%, or 100%.

Once improvement of the patient's conditions has occurred, a maintenance dose is administered if necessary. Subsequently, the dosage or the frequency of administration, or both, are optionally reduced, as a function of the symptoms, to a level at which the improved disease, disorder or condition is retained.

In some embodiments, the amount of a given agent that correspond to such an amount varies depending upon factors such as the particular compound, the severity of the disease, the identity (e.g., weight) of the subject or host in need of treatment, but nevertheless is routinely determined in a manner known in the art according to the particular circumstances surrounding the case, including, e.g., the specific agent being administered, the route of administration, and the subject or host being treated. In some instances, the desired dose is conveniently presented in a single dose or as divided doses administered simultaneously (or over a short period of time) or at appropriate intervals, for example as two, three, four or more sub-doses per day.

The foregoing ranges are merely suggestive, as the number of variables in regard to an individual treatment regime is large, and considerable excursions from these recommended values are not uncommon. Such dosages are altered depending on a number of variables, not limited to the activity of the compound used, the disease or condition to be treated, the mode of administration, the requirements of the individual subject, the severity of the disease or condition being treated, and the judgment of the practitioner.

In some embodiments, toxicity and therapeutic efficacy of such therapeutic regimens are determined by standard pharmaceutical procedures in cell cultures or experimental animals, including, but not limited to, the determination of the LD50 (the dose lethal to 50% of the population) and the ED50 (the dose therapeutically effective in 50% of the population). The dose ratio between the toxic and therapeutic effects is the therapeutic index and it is expressed as the ratio between LD50 and ED50. Compounds exhibiting high therapeutic indices are preferred. The data obtained from cell culture assays and animal studies are used in formulating a range of dosage for use in humans. The dosage of such compounds lies preferably within a range of circulating concentrations that include the ED50 with minimal toxicity. The dosage varies within this range depending upon the dosage form employed and the route of administration utilized.

Kits/Article of Manufacture

Disclosed herein, in certain embodiments, are kits and articles of manufacture for use with one or more of the compositions and methods described herein. Such kits include a carrier, package, or container that is compartmentalized to receive one or more containers such as vials, tubes, and the like, each of the container(s) comprising one of the separate elements to be used in a method described herein. Suitable containers include, for example, bottles, vials, syringes, and test tubes. In one embodiment, the containers are formed from a variety of materials such as glass or plastic.

The articles of manufacture provided herein contain packaging materials. Examples of pharmaceutical packaging materials include, but are not limited to, blister packs, bottles, tubes, bags, containers, bottles, and any packaging material suitable for a selected formulation and intended mode of administration and treatment.

For example, the container(s) include EGFR nucleic acid molecule described herein. Such kits optionally include an identifying description or label or instructions relating to its use in the methods described herein.

A kit typically includes labels listing contents and/or instructions for use and package inserts with instructions for use. A set of instructions will also typically be included.

In one embodiment, a label is on or associated with the container. In one embodiment, a label is on a container when letters, numbers, or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

In certain embodiments, the pharmaceutical compositions are presented in a pack or dispenser device which contains one or more unit dosage forms containing a compound provided herein. The pack, for example, contains metal or plastic foil, such as a blister pack. In one embodiment, the pack or dispenser device is accompanied by instructions for administration. In one embodiment, the pack or dispenser is also accompanied with a notice associated with the container in a form prescribed by a governmental agency regulating the manufacture, use, or sale of pharmaceuticals, which notice is reflective of approval by the agency of the form of the drug for human or veterinary administration. Such notice, for example, is the labeling approved by the U.S. Food and Drug Administration for prescription drugs, or the approved product insert. In one embodiment, compositions containing a compound provided herein formulated in a compatible pharmaceutical carrier are also prepared, placed in an appropriate container, and labeled for treatment of an indicated condition.

Certain Terminology

Unless defined otherwise, all technical and scientific terms used herein have the same meaning as is commonly understood by one of skill in the art to which the claimed subject matter belongs. It is to be understood that the general description and the detailed description are exemplary and explanatory only and are not restrictive of any subject matter claimed. In this application, the use of the singular includes the plural unless specifically stated otherwise. It must be noted that, as used in the specification, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used herein, ranges and amounts can be expressed as "about" a particular value or range. About also includes the exact amount. Hence "about 5 µL" means "about 5 µL" and also "5 µL." Generally, the term "about" includes an amount that is expected to be within experimental error, e.g., ±5%, ±10%, or ±15%.

The section headings used herein are for organizational purposes only and are not to be construed as limiting the subject matter described.

As used herein, the terms "individual(s)", "subject(s)" and "patient(s)" mean any mammal. In some embodiments, the mammal is a human. In some embodiments, the mammal is a non-human. None of the terms require or are limited to situations characterized by the supervision (e.g. constant or intermittent) of a health care worker (e.g. a doctor, a registered nurse, a nurse practitioner, a physician's assistant, an orderly or a hospice worker).

EXAMPLES

These examples are provided for illustrative purposes only and not to limit the scope of the claims provided herein.

Example 1. Sequences

Table 1 illustrates target sequences described herein. Tables 2, 3, and 6 illustrate polynucleic acid molecule sequences described herein.

TABLE 1

EGFR Target Sequences

| hs Id # | 19mer pos. in NM_005228.3 | sequence of total 23mer target site in NM_005228.3 | SEQ ID NO: |
|---|---|---|---|
| 68 | 68-86 | GGCGGCCGGAGUCCCGAGCUAGC | 1 |
| 71 | 71-89 | GGCCGGAGUCCCGAGCUAGCCCC | 2 |
| 72 | 72-90 | GCCGGAGUCCCGAGCUAGCCCCG | 3 |
| 73 | 73-91 | CCGGAGUCCCGAGCUAGCCCCGG | 4 |
| 74 | 74-92 | CGGAGUCCCGAGCUAGCCCCGGC | 5 |

TABLE 1-continued

EGFR Target Sequences

| hs Id # | 19mer pos. in NM_005228.3 | sequence of total 23mer target site in NM_005228.3 | SEQ ID NO: |
|---|---|---|---|
| 75 | 75-93 | GGAGUCCCGAGCUAGCCCCGGCG | 6 |
| 76 | 76-94 | GAGUCCCGAGCUAGCCCCGGCGG | 7 |
| 78 | 78-96 | GUCCCGAGCUAGCCCCGGCGGCC | 8 |
| 114 | 114-132 | CCGGACGACAGGCCACCUCGUCG | 9 |
| 115 | 115-133 | CGGACGACAGGCCACCUCGUCGG | 10 |
| 116 | 116-134 | GGACGACAGGCCACCUCGUCGGC | 11 |
| 117 | 117-135 | GACGACAGGCCACCUCGUCGGCG | 12 |
| 118 | 118-136 | ACGACAGGCCACCUCGUCGGCGU | 13 |
| 120 | 120-138 | GACAGGCCACCUCGUCGGCGUCC | 14 |
| 121 | 121-139 | ACAGGCCACCUCGUCGGCGUCCG | 15 |
| 122 | 122-140 | CAGGCCACCUCGUCGGCGUCCGC | 16 |
| 123 | 123-141 | AGGCCACCUCGUCGGCGUCCGCC | 17 |
| 124 | 124-142 | GGCCACCUCGUCGGCGUCCGCCC | 18 |
| 125 | 125-143 | GCCACCUCGUCGGCGUCCGCCCG | 19 |
| 126 | 126-144 | CCACCUCGUCGGCGUCCGCCCGA | 20 |
| 127 | 127-145 | CACCUCGUCGGCGUCCGCCCGAG | 21 |
| 128 | 128-146 | ACCUCGUCGGCGUCCGCCCGAGU | 22 |
| 129 | 129-147 | CCUCGUCGGCGUCCGCCCGAGUC | 23 |
| 130 | 130-148 | CUCGUCGGCGUCCGCCCGAGUCC | 24 |
| 131 | 131-149 | UCGUCGGCGUCCGCCCGAGUCCC | 25 |
| 132 | 132-150 | CGUCGGCGUCCGCCCGAGUCCCC | 26 |
| 135 | 135-153 | CGGCGUCCGCCCGAGUCCCCGCC | 27 |
| 136 | 136-154 | GGCGUCCGCCCGAGUCCCCGCCU | 28 |
| 141 | 141-159 | CCGCCCGAGUCCCCGCCUCGCCG | 29 |
| 164 | 164-182 | CCAACGCCACAACCACCGCGCAC | 30 |
| 165 | 165-183 | CAACGCCACAACCACCGCGCACG | 31 |
| 166 | 166-184 | AACGCCACAACCACCGCGCACGG | 32 |
| 168 | 168-186 | CGCCACAACCACCGCGCACGGCC | 33 |
| 169 | 169-187 | GCCACAACCACCGCGCACGGCCC | 34 |
| 170 | 170-188 | CCACAACCACCGCGCACGGCCCC | 35 |
| 247 | 247-265 | CGAUGCGACCCUCCGGGACGGCC | 36 |
| 248 | 248-266 | GAUGCGACCCUCCGGGACGGCCG | 37 |
| 249 | 249-267 | AUGCGACCCUCCGGGACGGCCGG | 38 |
| 251 | 251-269 | GCGACCCUCCGGGACGGCCGGGG | 39 |
| 252 | 252-270 | CGACCCUCCGGGACGGCCGGGGC | 40 |
| 254 | 254-272 | ACCCUCCGGGACGGCCGGGGCAG | 41 |
| 329 | 329-347 | AAAGAAAGUUUGCCAAGGCACGA | 42 |
| 330 | 330-348 | AAGAAAGUUUGCCAAGGCACGAG | 43 |
| 332 | 332-350 | GAAAGUUUGCCAAGGCACGAGUA | 44 |
| 333 | 333-351 | AAAGUUUGCCAAGGCACGAGUAA | 45 |
| 334 | 334-352 | AAGUUUGCCAAGGCACGAGUAAC | 46 |
| 335 | 335-353 | AGUUUGCCAAGGCACGAGUAACA | 47 |
| 336 | 336-354 | GUUUGCCAAGGCACGAGUAACAA | 48 |
| 337 | 337-355 | UUUGCCAAGGCACGAGUAACAAG | 49 |
| 338 | 338-356 | UUGCCAAGGCACGAGUAACAAGC | 50 |
| 361 | 361-379 | UCACGCAGUUGGGCACUUUUGAA | 51 |
| 362 | 362-380 | CACGCAGUUGGGCACUUUUGAAG | 52 |
| 363 | 363-381 | ACGCAGUUGGGCACUUUUGAAGA | 53 |
| 364 | 364-382 | CGCAGUUGGGCACUUUUGAAGAU | 54 |
| 365 | 365-383 | GCAGUUGGGCACUUUUGAAGAUC | 55 |
| 366 | 366-384 | CAGUUGGGCACUUUUGAAGAUCA | 56 |
| 367 | 367-385 | AGUUGGGCACUUUUGAAGAUCAU | 57 |
| 368 | 368-386 | GUUGGGCACUUUUGAAGAUCAUU | 58 |
| 369 | 369-387 | UUGGGCACUUUUGAAGAUCAUUU | 59 |
| 377 | 377-395 | UUUUGAAGAUCAUUUUCUCAGCC | 60 |
| 379 | 379-397 | UUGAAGAUCAUUUUCUCAGCCUC | 61 |
| 380 | 380-398 | UGAAGAUCAUUUUCUCAGCCUCC | 62 |
| 385 | 385-403 | AUCAUUUUCUCAGCCUCCAGAGG | 63 |
| 394 | 394-412 | UCAGCCUCCAGAGGAUGUUCAAU | 64 |
| 396 | 396-414 | AGCCUCCAGAGGAUGUUCAAUAA | 65 |
| 397 | 397-415 | GCCUCCAGAGGAUGUUCAAUAAC | 66 |
| 401 | 401-419 | CCAGAGGAUGUUCAAUAACUGUG | 67 |
| 403 | 403-421 | AGAGGAUGUUCAAUAACUGUGAG | 68 |
| 407 | 407-425 | GAUGUUCAAUAACUGUGAGGUGG | 69 |
| 409 | 409-427 | UGUUCAAUAACUGUGAGGUGGUC | 70 |
| 410 | 410-428 | GUUCAAUAACUGUGAGGUGGUCC | 71 |
| 411 | 411-429 | UUCAAUAACUGUGAGGUGGUCCU | 72 |
| 412 | 412-430 | UCAAUAACUGUGAGGUGGUCCUU | 73 |
| 413 | 413-431 | CAAUAACUGUGAGGUGGUCCUUG | 74 |
| 414 | 414-432 | AAUAACUGUGAGGUGGUCCUUGG | 75 |
| 416 | 416-434 | UAACUGUGAGGUGGUCCUUGGGA | 76 |
| 418 | 418-436 | ACUGUGAGGUGGUCCUUGGGAAU | 77 |
| 419 | 419-437 | CUGUGAGGUGGUCCUUGGGAAUU | 78 |
| 425 | 425-443 | GGUGGUCCUUGGGAAUUUGGAAA | 79 |

TABLE 1-continued

EGFR Target Sequences

| hs Id # | 19mer pos. in NM_005228.3 | sequence of total 23mer target site in NM_005228.3 | SEQ ID NO: | hs Id # | 19mer pos. in NM_005228.3 | sequence of total 23mer target site in NM_005228.3 | SEQ ID NO: |
|---|---|---|---|---|---|---|---|
| 431 | 431-449 | CCUUGGGAAUUUGGAAAUUACCU | 80 | 597 | 597-615 | UAUGCCUUAGCAGUCUUAUCUAA | 117 |
| 432 | 432-450 | CUUGGGAAUUUGGAAAUUACCUA | 81 | 598 | 598-616 | AUGCCUUAGCAGUCUUAUCUAAC | 118 |
| 433 | 433-451 | UUGGGAAUUUGGAAAUUACCUAU | 82 | 599 | 599-617 | UGCCUUAGCAGUCUUAUCUAACU | 119 |
| 434 | 434-452 | UGGGAAUUUGGAAAUUACCUAUG | 83 | 600 | 600-618 | GCCUUAGCAGUCUUAUCUAACUA | 120 |
| 458 | 458-476 | GCAGAGGAAUUAUGAUCUUUCCU | 84 | 601 | 601-619 | CCUUAGCAGUCUUAUCUAACUAU | 121 |
| 459 | 459-477 | CAGAGGAAUUAUGAUCUUUCCUU | 85 | 602 | 602-620 | CUUAGCAGUCUUAUCUAACUAUG | 122 |
| 463 | 463-481 | GGAAUUAUGAUCUUUCCUUCUUA | 86 | 603 | 603-621 | UUAGCAGUCUUAUCUAACUAUGA | 123 |
| 464 | 464-482 | GAAUUAUGAUCUUUCCUUCUUAA | 87 | 604 | 604-622 | UAGCAGUCUUAUCUAACUAUGAU | 124 |
| 466 | 466-484 | AUUAUGAUCUUUCCUUCUUAAAG | 88 | 605 | 605-623 | AGCAGUCUUAUCUAACUAUGAUG | 125 |
| 468 | 468-486 | UAUGAUCUUUCCUUCUUAAAGAC | 89 | 608 | 608-626 | AGUCUUAUCUAACUAUGAUGCAA | 126 |
| 471 | 471-489 | GAUCUUUCCUUCUUAAAGACCAU | 90 | 609 | 609-627 | GUCUUAUCUAACUAUGAUGCAAA | 127 |
| 476 | 476-494 | UUCCUUCUUAAAGACCAUCCAGG | 91 | 610 | 610-628 | UCUUAUCUAACUAUGAUGCAAAU | 128 |
| 477 | 477-495 | UCCUUCUUAAAGACCAUCCAGGA | 92 | 611 | 611-629 | CUUAUCUAACUAUGAUGCAAAUA | 129 |
| 479 | 479-497 | CUUCUUAAAGACCAUCCAGGAGG | 93 | 612 | 612-630 | UUAUCUAACUAUGAUGCAAAUAA | 130 |
| 481 | 481-499 | UCUUAAAGACCAUCCAGGAGGUG | 94 | 613 | 613-631 | UAUCUAACUAUGAUGCAAAUAAA | 131 |
| 482 | 482-500 | CUUAAAGACCAUCCAGGAGGUGG | 95 | 614 | 614-632 | AUCUAACUAUGAUGCAAAUAAAA | 132 |
| 492 | 492-510 | AUCCAGGAGGUGGCUGGUUAUGU | 96 | 616 | 616-634 | CUAACUAUGAUGCAAAUAAAACC | 133 |
| 493 | 493-511 | UCCAGGAGGUGGCUGGUUAUGUC | 97 | 622 | 622-640 | AUGAUGCAAAUAAAACCGGACUG | 134 |
| 494 | 494-512 | CCAGGAGGUGGCUGGUUAUGUCC | 98 | 623 | 623-641 | UGAUGCAAAUAAAACCGGACUGA | 135 |
| 495 | 495-513 | CAGGAGGUGGCUGGUUAUGUCCU | 99 | 624 | 624-642 | GAUGCAAAUAAAACCGGACUGAA | 136 |
| 496 | 496-514 | AGGAGGUGGCUGGUUAUGUCCUC | 100 | 626 | 626-644 | UGCAAAUAAAACCGGACUGAAGG | 137 |
| 497 | 497-515 | GGAGGUGGCUGGUUAUGUCCUCA | 101 | 627 | 627-645 | GCAAAUAAAACCGGACUGAAGGA | 138 |
| 499 | 499-517 | AGGUGGCUGGUUAUGUCCUCAUU | 102 | 628 | 628-646 | CAAAUAAAACCGGACUGAAGGAG | 139 |
| 520 | 520-538 | UUGCCCUCAACACAGUGGAGCGA | 103 | 630 | 630-648 | AAUAAAACCGGACUGAAGGAGCU | 140 |
| 542 | 542-560 | AAUUCCUUUGGAAAACCUGCAGA | 104 | 631 | 631-649 | AUAAAACCGGACUGAAGGAGCUG | 141 |
| 543 | 543-561 | AUUCCUUUGGAAAACCUGCAGAU | 105 | 632 | 632-650 | UAAAACCGGACUGAAGGAGCUGC | 142 |
| 550 | 550-568 | UGGAAAACCUGCAGAUCAUCAGA | 106 | 633 | 633-651 | AAAACCGGACUGAAGGAGCUGCC | 143 |
| 551 | 551-569 | GGAAAACCUGCAGAUCAUCAGAG | 107 | 644 | 644-662 | GAAGGAGCUGCCCAUGAGAAAUU | 144 |
| 553 | 553-571 | AAAACCUGCAGAUCAUCAGAGGA | 108 | 665 | 665-683 | UUUACAGGAAAUCCUGCAUGGCG | 145 |
| 556 | 556-574 | ACCUGCAGAUCAUCAGAGGAAAU | 109 | 668 | 668-686 | ACAGGAAAUCCUGCAUGGCGCCG | 146 |
| 586 | 586-604 | ACGAAAAUUCCUAUGCCUUAGCA | 110 | 669 | 669-687 | CAGGAAAUCCUGCAUGGCGCCGU | 147 |
| 587 | 587-605 | CGAAAAUUCCUAUGCCUUAGCAG | 111 | 670 | 670-688 | AGGAAAUCCUGCAUGGCGCCGUG | 148 |
| 589 | 589-607 | AAAAUUCCUAUGCCUUAGCAGUC | 112 | 671 | 671-689 | GGAAAUCCUGCAUGGCGCCGUGC | 149 |
| 592 | 592-610 | AUUCCUAUGCCUUAGCAGUCUUA | 113 | 672 | 672-690 | GAAAUCCUGCAUGGCGCCGUGCG | 150 |
| 593 | 593-611 | UUCCUAUGCCUUAGCAGUCUUAU | 114 | 674 | 674-692 | AAUCCUGCAUGGCGCCGUGCGGU | 151 |
| 594 | 594-612 | UCCUAUGCCUUAGCAGUCUUAUC | 115 | 676 | 676-694 | UCCUGCAUGGCGCCGUGCGGUUC | 152 |
| 596 | 596-614 | CUAUGCCUUAGCAGUCUUAUCUA | 116 | 677 | 677-695 | CCUGCAUGGCGCCGUGCGGUUCA | 153 |

TABLE 1-continued

EGFR Target Sequences

| hs Id # | 19mer pos. in NM_005228.3 | sequence of total 23mer target site in NM_005228.3 | SEQ ID NO: |
|---|---|---|---|
| 678 | 678-696 | CUGCAUGGCGCCGUGCGGUUCAG | 154 |
| 680 | 680-698 | GCAUGGCGCCGUGCGGUUCAGCA | 155 |
| 681 | 681-699 | CAUGGCGCCGUGCGGUUCAGCAA | 156 |
| 682 | 682-700 | AUGGCGCCGUGCGGUUCAGCAAC | 157 |
| 683 | 683-701 | UGGCGCCGUGCGGUUCAGCAACA | 158 |
| 684 | 684-702 | GGCGCCGUGCGGUUCAGCAACAA | 159 |
| 685 | 685-703 | GCGCCGUGCGGUUCAGCAACAAC | 160 |
| 686 | 686-704 | CGCCGUGCGGUUCAGCAACAACC | 161 |
| 688 | 688-706 | CCGUGCGGUUCAGCAACAACCCU | 162 |
| 690 | 690-708 | GUGCGGUUCAGCAACAACCCUGC | 163 |
| 692 | 692-710 | GCGGUUCAGCAACAACCCUGCCC | 164 |
| 698 | 698-716 | CAGCAACAACCCUGCCCUGUGCA | 165 |
| 700 | 700-718 | GCAACAACCCUGCCCUGUGCAAC | 166 |
| 719 | 719-737 | CAACGUGGAGAGCAUCCAGUGGC | 167 |
| 720 | 720-738 | AACGUGGAGAGCAUCCAGUGGCG | 168 |
| 721 | 721-739 | ACGUGGAGAGCAUCCAGUGGCGG | 169 |
| 724 | 724-742 | UGGAGAGCAUCCAGUGGCGGGAC | 170 |
| 725 | 725-743 | GGAGAGCAUCCAGUGGCGGGACA | 171 |
| 726 | 726-744 | GAGAGCAUCCAGUGGCGGGACAU | 172 |
| 733 | 733-751 | UCCAGUGGCGGGACAUAGUCAGC | 173 |
| 734 | 734-752 | CCAGUGGCGGGACAUAGUCAGCA | 174 |
| 736 | 736-754 | AGUGGCGGGACAUAGUCAGCAGU | 175 |
| 737 | 737-755 | GUGGCGGGACAUAGUCAGCAGUG | 176 |
| 763 | 763-781 | UUCUCAGCAACAUGUCGAUGGAC | 177 |
| 765 | 765-783 | CUCAGCAACAUGUCGAUGGACUU | 178 |
| 766 | 766-784 | UCAGCAACAUGUCGAUGGACUUC | 179 |
| 767 | 767-785 | CAGCAACAUGUCGAUGGACUUCC | 180 |
| 769 | 769-787 | GCAACAUGUCGAUGGACUUCCAG | 181 |
| 770 | 770-788 | CAACAUGUCGAUGGACUUCCAGA | 182 |
| 771 | 771-789 | AACAUGUCGAUGGACUUCCAGAA | 183 |
| 772 | 772-790 | ACAUGUCGAUGGACUUCCAGAAC | 184 |
| 775 | 775-793 | UGUCGAUGGACUUCCAGAACCAC | 185 |
| 789 | 789-807 | CAGAACCACCUGGGCAGCUGCCA | 186 |
| 798 | 798-816 | CUGGGCAGCUGCCAAAAGUGUGA | 187 |
| 800 | 800-818 | GGGCAGCUGCCAAAAGUGUGAUC | 188 |
| 805 | 805-823 | GCUGCCAAAAGUGUGAUCCAAGC | 189 |
| 806 | 806-824 | CUGCCAAAAGUGUGAUCCAAGCU | 190 |
| 807 | 807-825 | UGCCAAAAGUGUGAUCCAAGCUG | 191 |
| 810 | 810-828 | CAAAAGUGUGAUCCAAGCUGUCC | 192 |
| 814 | 814-832 | AGUGUGAUCCAAGCUGUCCCAAU | 193 |
| 815 | 815-833 | GUGUGAUCCAAGCUGUCCCAAUG | 194 |
| 817 | 817-835 | GUGAUCCAAGCUGUCCCAAUGGG | 195 |
| 818 | 818-836 | UGAUCCAAGCUGUCCCAAUGGGA | 196 |
| 819 | 819-837 | GAUCCAAGCUGUCCCAAUGGGAG | 197 |
| 820 | 820-838 | AUCCAAGCUGUCCCAAUGGGAGC | 198 |
| 821 | 821-839 | UCCAAGCUGUCCCAAUGGGAGCU | 199 |
| 823 | 823-841 | CAAGCUGUCCCAAUGGGAGCUGC | 200 |
| 826 | 826-844 | GCUGUCCCAAUGGGAGCUGCUGG | 201 |
| 847 | 847-865 | GGGGUGCAGGAGAGGAGAACUGC | 202 |
| 871 | 871-889 | AGAAACUGACCAAAAUCAUCUGU | 203 |
| 872 | 872-890 | GAAACUGACCAAAAUCAUCUGUG | 204 |
| 873 | 873-891 | AAACUGACCAAAAUCAUCUGUGC | 205 |
| 877 | 877-895 | UGACCAAAAUCAUCUGUGCCCAG | 206 |
| 878 | 878-896 | GACCAAAAUCAUCUGUGCCCAGC | 207 |
| 881 | 881-899 | CAAAAUCAUCUGUGCCCAGCAGU | 208 |
| 890 | 890-908 | CUGUGCCCAGCAGUGCUCCGGGC | 209 |
| 892 | 892-910 | GUGCCCAGCAGUGCUCCGGGCGC | 210 |
| 929 | 929-947 | CCCCAGUGACUGCUGCCACAACC | 211 |
| 930 | 930-948 | CCCAGUGACUGCUGCCACAACCA | 212 |
| 979 | 979-997 | GGGAGAGCGACUGCCUGGUCUGC | 213 |
| 980 | 980-998 | GGAGAGCGACUGCCUGGUCUGCC | 214 |
| 981 | 981-999 | GAGAGCGACUGCCUGGUCUGCCG | 215 |
| 982 | 982-1000 | AGAGCGACUGCCUGGUCUGCCGC | 216 |
| 983 | 983-1001 | GAGCGACUGCCUGGUCUGCCGCA | 217 |
| 984 | 984-1002 | AGCGACUGCCUGGUCUGCCGCAA | 218 |
| 989 | 989-1007 | CUGCCUGGUCUGCCGCAAAUUCC | 219 |
| 990 | 990-1008 | UGCCUGGUCUGCCGCAAAUUCCG | 220 |
| 991 | 991-1009 | GCCUGGUCUGCCGCAAAUUCCGA | 221 |
| 992 | 992-1010 | CCUGGUCUGCCGCAAAUUCCGAG | 222 |
| 994 | 994-1012 | UGGUCUGCCGCAAAUUCCGAGAC | 223 |
| 995 | 995-1013 | GGUCUGCCGCAAAUUCCGAGACG | 224 |
| 996 | 996-1014 | GUCUGCCGCAAAUUCCGAGACGA | 225 |
| 997 | 997-1015 | UCUGCCGCAAAUUCCGAGACGAA | 226 |
| 999 | 999-1017 | UGCCGCAAAUUCCGAGACGAAGC | 227 |

TABLE 1-continued

EGFR Target Sequences

| hs Id # | 19mer pos. in NM_005228.3 | sequence of total 23mer target site in NM_005228.3 | SEQ ID NO: |
|---|---|---|---|
| 1004 | 1004-1022 | CAAAUUCCGAGACGAAGCCACGU | 228 |
| 1005 | 1005-1023 | AAAUUCCGAGACGAAGCCACGUG | 229 |
| 1006 | 1006-1024 | AAUUCCGAGACGAAGCCACGUGC | 230 |
| 1007 | 1007-1025 | AUUCCGAGACGAAGCCACGUGCA | 231 |
| 1008 | 1008-1026 | UUCCGAGACGAAGCCACGUGCAA | 232 |
| 1010 | 1010-1028 | CCGAGACGAAGCCACGUGCAAGG | 233 |
| 1013 | 1013-1031 | AGACGAAGCCACGUGCAAGGACA | 234 |
| 1014 | 1014-1032 | GACGAAGCCACGUGCAAGGACAC | 235 |
| 1015 | 1015-1033 | ACGAAGCCACGUGCAAGGACACC | 236 |
| 1016 | 1016-1034 | CGAAGCCACGUGCAAGGACACCU | 237 |
| 1040 | 1040-1058 | CCCCCCACUCAUGCUCUACAACC | 238 |
| 1042 | 1042-1060 | CCCCACUCAUGCUCUACAACCCC | 239 |
| 1044 | 1044-1062 | CCACUCAUGCUCUACAACCCCAC | 240 |
| 1047 | 1047-1065 | CUCAUGCUCUACAACCCCACCAC | 241 |
| 1071 | 1071-1089 | UACCAGAUGGAUGUGAACCCCGA | 242 |
| 1073 | 1073-1091 | CCAGAUGGAUGUGAACCCCGAGG | 243 |
| 1074 | 1074-1092 | CAGAUGGAUGUGAACCCCGAGGG | 244 |
| 1075 | 1075-1093 | AGAUGGAUGUGAACCCCGAGGGC | 245 |
| 1077 | 1077-1095 | AUGGAUGUGAACCCCGAGGGCAA | 246 |
| 1078 | 1078-1096 | UGGAUGUGAACCCCGAGGGCAAA | 247 |
| 1080 | 1080-1098 | GAUGUGAACCCCGAGGGCAAAUA | 248 |
| 1084 | 1084-1102 | UGAACCCCGAGGGCAAAUACAGC | 249 |
| 1085 | 1085-1103 | GAACCCCGAGGGCAAAUACAGCU | 250 |
| 1087 | 1087-1105 | ACCCCGAGGGCAAAUACAGCUUU | 251 |
| 1088 | 1088-1106 | CCCCGAGGGCAAAUACAGCUUUG | 252 |
| 1089 | 1089-1107 | CCCGAGGGCAAAUACAGCUUUGG | 253 |
| 1096 | 1096-1114 | GCAAAUACAGCUUUGGUGCCACC | 254 |
| 1097 | 1097-1115 | CAAAUACAGCUUUGGUGCCACCU | 255 |
| 1098 | 1098-1116 | AAAUACAGCUUUGGUGCCACCUG | 256 |
| 1104 | 1104-1122 | AGCUUUGGUGCCACCUGCGUGAA | 257 |
| 1106 | 1106-1124 | CUUUGGUGCCACCUGCGUGAAGA | 258 |
| 1112 | 1112-1130 | UGCCACCUGCGUGAAGAAGUGUC | 259 |
| 1116 | 1116-1134 | ACCUGCGUGAAGAAGUGUCCCCG | 260 |
| 1117 | 1117-1135 | CCUGCGUGAAGAAGUGUCCCCGU | 261 |
| 1118 | 1118-1136 | CUGCGUGAAGAAGUGUCCCCGUA | 262 |
| 1119 | 1119-1137 | UGCGUGAAGAAGUGUCCCCGUAA | 263 |
| 1120 | 1120-1138 | GCGUGAAGAAGUGUCCCCGUAAU | 264 |
| 1121 | 1121-1139 | CGUGAAGAAGUGUCCCCGUAAUU | 265 |
| 1122 | 1122-1140 | GUGAAGAAGUGUCCCCGUAAUUA | 266 |
| 1123 | 1123-1141 | UGAAGAAGUGUCCCCGUAAUUAU | 267 |
| 1124 | 1124-1142 | GAAGAAGUGUCCCCGUAAUUAUG | 268 |
| 1125 | 1125-1143 | AAGAAGUGUCCCCGUAAUUAUGU | 269 |
| 1126 | 1126-1144 | AGAAGUGUCCCCGUAAUUAUGUG | 270 |
| 1127 | 1127-1145 | GAAGUGUCCCCGUAAUUAUGUGG | 271 |
| 1128 | 1128-1146 | AAGUGUCCCCGUAAUUAUGUGGU | 272 |
| 1129 | 1129-1147 | AGUGUCCCCGUAAUUAUGUGGUG | 273 |
| 1130 | 1130-1148 | GUGUCCCCGUAAUUAUGUGGUGA | 274 |
| 1132 | 1132-1150 | GUCCCCGUAAUUAUGUGGUGACA | 275 |
| 1134 | 1134-1152 | CCCCGUAAUUAUGUGGUGACAGA | 276 |
| 1136 | 1136-1154 | CCGUAAUUAUGUGGUGACAGAUC | 277 |
| 1137 | 1137-1155 | CGUAAUUAUGUGGUGACAGAUCA | 278 |
| 1138 | 1138-1156 | GUAAUUAUGUGGUGACAGAUCAC | 279 |
| 1139 | 1139-1157 | UAAUUAUGUGGUGACAGAUCACG | 280 |
| 1140 | 1140-1158 | AAUUAUGUGGUGACAGAUCACGG | 281 |
| 1142 | 1142-1160 | UUAUGUGGUGACAGAUCACGGCU | 282 |
| 1145 | 1145-1163 | UGUGGUGACAGAUCACGGCUCGU | 283 |
| 1147 | 1147-1165 | UGGUGACAGAUCACGGCUCGUGC | 284 |
| 1148 | 1148-1166 | GGUGACAGAUCACGGCUCGUGCG | 285 |
| 1149 | 1149-1167 | GUGACAGAUCACGGCUCGUGCGU | 286 |
| 1150 | 1150-1168 | UGACAGAUCACGGCUCGUGCGUC | 287 |
| 1151 | 1151-1169 | GACAGAUCACGGCUCGUGCGUCC | 288 |
| 1152 | 1152-1170 | ACAGAUCACGGCUCGUGCGUCCG | 289 |
| 1153 | 1153-1171 | CAGAUCACGGCUCGUGCGUCCGA | 290 |
| 1154 | 1154-1172 | AGAUCACGGCUCGUGCGUCCGAG | 291 |
| 1155 | 1155-1173 | GAUCACGGCUCGUGCGUCCGAGC | 292 |
| 1156 | 1156-1174 | AUCACGGCUCGUGCGUCCGAGCC | 293 |
| 1157 | 1157-1175 | UCACGGCUCGUGCGUCCGAGCCU | 294 |
| 1160 | 1160-1178 | CGGCUCGUGCGUCCGAGCCUGUG | 295 |
| 1200 | 1200-1218 | AUGGAGGAAGACGGCGUCCGCAA | 296 |
| 1201 | 1201-1219 | UGGAGGAAGACGGCGUCCGCAAG | 297 |
| 1203 | 1203-1221 | GAGGAAGACGGCGUCCGCAAGUG | 298 |
| 1204 | 1204-1222 | AGGAAGACGGCGUCCGCAAGUGU | 299 |
| 1205 | 1205-1223 | GGAAGACGGCGUCCGCAAGUGUA | 300 |
| 1207 | 1207-1225 | AAGACGGCGUCCGCAAGUGUAAG | 301 |

TABLE 1-continued

EGFR Target Sequences

| hs Id # | 19mer pos. in NM_005228.3 | sequence of total 23mer target site in NM_005228.3 | SEQ ID NO: |
|---|---|---|---|
| 1208 | 1208-1226 | AGACGGCGUCCGCAAGUGUAAGA | 302 |
| 1211 | 1211-1229 | CGGCGUCCGCAAGUGUAAGAAGU | 303 |
| 1212 | 1212-1230 | GGCGUCCGCAAGUGUAAGAAGUG | 304 |
| 1213 | 1213-1231 | GCGUCCGCAAGUGUAAGAAGUGC | 305 |
| 1214 | 1214-1232 | CGUCCGCAAGUGUAAGAAGUGCG | 306 |
| 1215 | 1215-1233 | GUCCGCAAGUGUAAGAAGUGCGA | 307 |
| 1216 | 1216-1234 | UCCGCAAGUGUAAGAAGUGCGAA | 308 |
| 1217 | 1217-1235 | CCGCAAGUGUAAGAAGUGCGAAG | 309 |
| 1219 | 1219-1237 | GCAAGUGUAAGAAGUGCGAAGGG | 310 |
| 1220 | 1220-1238 | CAAGUGUAAGAAGUGCGAAGGGC | 311 |
| 1221 | 1221-1239 | AAGUGUAAGAAGUGCGAAGGGCC | 312 |
| 1222 | 1222-1240 | AGUGUAAGAAGUGCGAAGGGCCU | 313 |
| 1223 | 1223-1241 | GUGUAAGAAGUGCGAAGGGCCUU | 314 |
| 1224 | 1224-1242 | UGUAAGAAGUGCGAAGGGCCUUG | 315 |
| 1225 | 1225-1243 | GUAAGAAGUGCGAAGGGCCUUGC | 316 |
| 1226 | 1226-1244 | UAAGAAGUGCGAAGGGCCUUGCC | 317 |
| 1229 | 1229-1247 | GAAGUGCGAAGGGCCUUGCCGCA | 318 |
| 1230 | 1230-1248 | AAGUGCGAAGGGCCUUGCCGCAA | 319 |
| 1231 | 1231-1249 | AGUGCGAAGGGCCUUGCCGCAAA | 320 |
| 1232 | 1232-1250 | GUGCGAAGGGCCUUGCCGCAAAG | 321 |
| 1233 | 1233-1251 | UGCGAAGGGCCUUGCCGCAAAGU | 322 |
| 1235 | 1235-1253 | CGAAGGGCCUUGCCGCAAAGUGU | 323 |
| 1236 | 1236-1254 | GAAGGGCCUUGCCGCAAAGUGUG | 324 |
| 1237 | 1237-1255 | AAGGGCCUUGCCGCAAAGUGUGU | 325 |
| 1238 | 1238-1256 | AGGGCCUUGCCGCAAAGUGUGUA | 326 |
| 1239 | 1239-1257 | GGGCCUUGCCGCAAAGUGUGUAA | 327 |
| 1241 | 1241-1259 | GCCUUGCCGCAAAGUGUGUAACG | 328 |
| 1261 | 1261-1279 | ACGGAAUAGGUAUUGGUGAAUUU | 329 |
| 1262 | 1262-1280 | CGGAAUAGGUAUUGGUGAAUUUA | 330 |
| 1263 | 1263-1281 | GGAAUAGGUAUUGGUGAAUUUAA | 331 |
| 1264 | 1264-1282 | GAAUAGGUAUUGGUGAAUUUAAA | 332 |
| 1266 | 1266-1284 | AUAGGUAUUGGUGAAUUUAAAGA | 333 |
| 1267 | 1267-1285 | UAGGUAUUGGUGAAUUUAAAGAC | 334 |
| 1289 | 1289-1307 | CUCACUCUCCAUAAAUGCUACGA | 335 |
| 1313 | 1313-1331 | UAUUAAACACUUCAAAAACUGCA | 336 |
| 1320 | 1320-1338 | CACUUCAAAAACUGCACCUCCAU | 337 |
| 1321 | 1321-1339 | ACUUCAAAAACUGCACCUCCAUC | 338 |
| 1322 | 1322-1340 | CUUCAAAAACUGCACCUCCAUCA | 339 |
| 1323 | 1323-1341 | UUCAAAAACUGCACCUCCAUCAG | 340 |
| 1324 | 1324-1342 | UCAAAAACUGCACCUCCAUCAGU | 341 |
| 1328 | 1328-1346 | AAACUGCACCUCCAUCAGUGGCG | 342 |
| 1332 | 1332-1350 | UGCACCUCCAUCAGUGGCGAUCU | 343 |
| 1333 | 1333-1351 | GCACCUCCAUCAGUGGCGAUCUC | 344 |
| 1335 | 1335-1353 | ACCUCCAUCAGUGGCGAUCUCCA | 345 |
| 1338 | 1338-1356 | UCCAUCAGUGGCGAUCUCCACAU | 346 |
| 1344 | 1344-1362 | AGUGGCGAUCUCCACAUCCUGCC | 347 |
| 1345 | 1345-1363 | GUGGCGAUCUCCACAUCCUGCCG | 348 |
| 1346 | 1346-1364 | UGGCGAUCUCCACAUCCUGCCGG | 349 |
| 1347 | 1347-1365 | GGCGAUCUCCACAUCCUGCCGGU | 350 |
| 1348 | 1348-1366 | GCGAUCUCCACAUCCUGCCGGUG | 351 |
| 1353 | 1353-1371 | CUCCACAUCCUGCCGGUGGCAUU | 352 |
| 1354 | 1354-1372 | UCCACAUCCUGCCGGUGGCAUUU | 353 |
| 1355 | 1355-1373 | CCACAUCCUGCCGGUGGCAUUUA | 354 |
| 1357 | 1357-1375 | ACAUCCUGCCGGUGGCAUUUAGG | 355 |
| 1360 | 1360-1378 | UCCUGCCGGUGGCAUUUAGGGGU | 356 |
| 1361 | 1361-1379 | CCUGCCGGUGGCAUUUAGGGGUG | 357 |
| 1362 | 1362-1380 | CUGCCGGUGGCAUUUAGGGGUGA | 358 |
| 1363 | 1363-1381 | UGCCGGUGGCAUUUAGGGGUGAC | 359 |
| 1366 | 1366-1384 | CGGUGGCAUUUAGGGGUGACUCC | 360 |
| 1369 | 1369-1387 | UGGCAUUUAGGGGUGACUCCUUC | 361 |
| 1370 | 1370-1388 | GGCAUUUAGGGGUGACUCCUUCA | 362 |
| 1371 | 1371-1389 | GCAUUUAGGGGUGACUCCUUCAC | 363 |
| 1372 | 1372-1390 | CAUUUAGGGGUGACUCCUUCACA | 364 |
| 1373 | 1373-1391 | AUUUAGGGGUGACUCCUUCACAC | 365 |
| 1374 | 1374-1392 | UUUAGGGGUGACUCCUUCACACA | 366 |
| 1404 | 1404-1422 | CCUCUGGAUCCACAGGAACUGGA | 367 |
| 1408 | 1408-1426 | UGGAUCCACAGGAACUGGAUAUU | 368 |
| 1409 | 1409-1427 | GGAUCCACAGGAACUGGAUAUUC | 369 |
| 1411 | 1411-1429 | AUCCACAGGAACUGGAUAUUCUG | 370 |
| 1412 | 1412-1430 | UCCACAGGAACUGGAUAUUCUGA | 371 |
| 1419 | 1419-1437 | GAACUGGAUAUUCUGAAAACCGU | 372 |
| 1426 | 1426-1444 | AUAUUCUGAAAACCGUAAAGGAA | 373 |
| 1427 | 1427-1445 | UAUUCUGAAAACCGUAAAGGAAA | 374 |

TABLE 1-continued

EGFR Target Sequences

| hs Id # | 19mer pos. in NM_005228.3 | sequence of total 23mer target site in NM_005228.3 | SEQ ID NO: |
|---|---|---|---|
| 1430 | 1430-1448 | UCUGAAAACCGUAAAGGAAAUCA | 375 |
| 1431 | 1431-1449 | CUGAAAACCGUAAAGGAAAUCAC | 376 |

TABLE 2

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 68 | 68-86 | CGGCCGGAGUCCCGAGCUATT | 377 | UAGCUCGGGACUCCGGCCGTT | 378 |
| 71 | 71-89 | CCGGAGUCCCGAGCUAGCCTT | 379 | GGCUAGCUCGGGACUCCGGTT | 380 |
| 72 | 72-90 | CGGAGUCCCGAGCUAGCCCTT | 381 | GGGCUAGCUCGGGACUCCGTT | 382 |
| 73 | 73-91 | GGAGUCCCGAGCUAGCCCCTT | 383 | GGGGCUAGCUCGGGACUCCTT | 384 |
| 74 | 74-92 | GAGUCCCGAGCUAGCCCCGTT | 385 | CGGGGCUAGCUCGGGACUCTT | 386 |
| 75 | 75-93 | AGUCCCGAGCUAGCCCCGGTT | 387 | CCGGGGCUAGCUCGGGACUTT | 388 |
| 76 | 76-94 | GUCCCGAGCUAGCCCCGGCTT | 389 | GCCGGGGCUAGCUCGGGACTT | 390 |
| 78 | 78-96 | CCCGAGCUAGCCCCGGCGGTT | 391 | CCGCCGGGGCUAGCUCGGGTT | 392 |
| 114 | 114-132 | GGACGACAGGCCACCUCGUTT | 393 | ACGAGGUGGCCUGUCGUCCTT | 394 |
| 115 | 115-133 | GACGACAGGCCACCUCGUCTT | 395 | GACGAGGUGGCCUGUCGUCTT | 396 |
| 116 | 116-134 | ACGACAGGCCACCUCGUCGTT | 397 | CGACGAGGUGGCCUGUCGUTT | 398 |
| 117 | 117-135 | CGACAGGCCACCUCGUCGGTT | 399 | CCGACGAGGUGGCCUGUCGTT | 400 |
| 118 | 118-136 | GACAGGCCACCUCGUCGGCTT | 401 | GCCGACGAGGUGGCCUGUCTT | 402 |
| 120 | 120-138 | CAGGCCACCUCGUCGGCGUTT | 403 | ACGCCGACGAGGUGGCCUGTT | 404 |
| 121 | 121-139 | AGGCCACCUCGUCGGCGUCTT | 405 | GACGCCGACGAGGUGGCCUTT | 406 |
| 122 | 122-140 | GGCCACCUCGUCGGCGUCCTT | 407 | GGACGCCGACGAGGUGGCCTT | 408 |
| 123 | 123-141 | GCCACCUCGUCGGCGUCCGTT | 409 | CGGACGCCGACGAGGUGGCTT | 410 |
| 124 | 124-142 | CCACCUCGUCGGCGUCCGCTT | 411 | GCGGACGCCGACGAGGUGGTT | 412 |
| 125 | 125-143 | CACCUCGUCGGCGUCCGCCTT | 413 | GGCGGACGCCGACGAGGUGTT | 414 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 126 | 126-144 | ACCUCGUCGGCGUCCGCCCTT | 415 | GGGCGGACGCCGACGAGGUTT | 416 |
| 127 | 127-145 | CCUCGUCGGCGUCCGCCGTT | 417 | CGGGCGGACGCCGACGAGGTT | 418 |
| 128 | 128-146 | CUCGUCGGCGUCCGCCCGATT | 419 | UCGGGCGGACGCCGACGAGTT | 420 |
| 129 | 129-147 | UCGUCGGCGUCCGCCCGAGTT | 421 | CUCGGGCGGACGCCGACGATT | 422 |
| 130 | 130-148 | CGUCGGCGUCCGCCCGAGUTT | 423 | ACUCGGGCGGACGCCGACGTT | 424 |
| 131 | 131-149 | GUCGGCGUCCGCCCGAGUCTT | 425 | GACUCGGGCGGACGCCGACTT | 426 |
| 132 | 132-150 | UCGGCGUCCGCCCGAGUCCTT | 427 | GGACUCGGGCGGACGCCGATT | 428 |
| 135 | 135-153 | GCGUCCGCCCGAGUCCCGTT | 429 | CGGGGACUCGGGCGGACGCTT | 430 |
| 136 | 136-154 | CGUCCGCCCGAGUCCCGCTT | 431 | GCGGGGACUCGGGCGGACGTT | 432 |
| 141 | 141-159 | GCCCGAGUCCCCGCCUCGCTT | 433 | GCGAGGCGGGGACUCGGGCTT | 434 |
| 164 | 164-182 | AACGCCACAACCACCGCGCTT | 435 | GCGCGGUGGUUGUGGCGUUTT | 436 |
| 165 | 165-183 | ACGCCACAACCACCGCGCATT | 437 | UGCGCGGUGGUUGUGGCGUTT | 438 |
| 166 | 166-184 | CGCCACAACCACCGCGCACTT | 439 | GUGCGCGGUGGUUGUGGCGTT | 440 |
| 168 | 168-186 | CCACAACCACCGCGCACGGTT | 441 | CCGUGCGCGGUGGUUGUGGTT | 442 |
| 169 | 169-187 | CACAACCACCGCGCACGGCTT | 443 | GCCGUGCGCGGUGGUUGUTT | 444 |
| 170 | 170-188 | ACAACCACCGCGCACGGCCTT | 445 | GGCCGUGCGCGGUGGUUGUTT | 446 |
| 247 | 247-265 | AUGCGACCCUCCGGGACGGTT | 447 | CCGUCCCGGAGGGUCGCAUTT | 448 |
| 248 | 248-266 | UGCGACCCUCCGGGACGGCTT | 449 | GCCGUCCCGGAGGGUCGCATT | 450 |
| 249 | 249-267 | GCGACCCUCCGGGACGGCCTT | 451 | GGCCGUCCCGGAGGGUCGCTT | 452 |
| 251 | 251-269 | GACCCUCCGGGACGGCCGGTT | 453 | CCGGCCGUCCCGGAGGGUCTT | 454 |
| 252 | 252-270 | ACCCUCCGGGACGGCCGGGTT | 455 | CCCGGCCGUCCCGGAGGGUTT | 456 |
| 254 | 254-272 | CCUCCGGGACGGCCGGGGCTT | 457 | GCCCCGGCCGUCCCGGAGGTT | 458 |
| 329 | 329-347 | AGAAAGUUUGCCAAGGCACTT | 459 | GUGCCUUGGCAAACUUUCUTT | 460 |
| 330 | 330-348 | GAAAGUUUGCCAAGGCACGTT | 461 | CGUGCCUUGGCAAACUUUCTT | 462 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 332 | 332-350 | AAGUUUGCCAAGGCACGAGTT | 463 | CUCGUGCCUUGGCAAACUUTT | 464 |
| 333 | 333-351 | AGUUUGCCAAGGCACGAGUTT | 465 | ACUCGUGCCUUGGCAAACUTT | 466 |
| 334 | 334-352 | GUUUGCCAAGGCACGAGUATT | 467 | UACUCGUGCCUUGGCAAACTT | 468 |
| 335 | 335-353 | UUUGCCAAGGCACGAGUAATT | 469 | UUACUCGUGCCUUGGCAAATT | 470 |
| 336 | 336-354 | UUGCCAAGGCACGAGUAACTT | 471 | GUUACUCGUGCCUUGGCAATT | 472 |
| 337 | 337-355 | UGCCAAGGCACGAGUAACATT | 473 | UGUUACUCGUGCCUUGGCATT | 474 |
| 338 | 338-356 | GCCAAGGCACGAGUAACAATT | 475 | UUGUUACUCGUGCCUUGGCTT | 476 |
| 361 | 361-379 | ACGCAGUUGGGCACUUUUGTT | 477 | CAAAAGUGCCCAACUGCGUTT | 478 |
| 362 | 362-380 | CGCAGUUGGGCACUUUUGATT | 479 | UCAAAAGUGCCCAACUGCGTT | 480 |
| 363 | 363-381 | GCAGUUGGGCACUUUUGAATT | 481 | UUCAAAAGUGCCCAACUGCTT | 482 |
| 364 | 364-382 | CAGUUGGGCACUUUUGAAGTT | 483 | CUUCAAAAGUGCCCAACUGTT | 484 |
| 365 | 365-383 | AGUUGGGCACUUUUGAAGATT | 485 | UCUUCAAAAGUGCCCAACUTT | 486 |
| 366 | 366-384 | GUUGGGCACUUUUGAAGAUTT | 487 | AUCUUCAAAAGUGCCCAACTT | 488 |
| 367 | 367-385 | UUGGGCACUUUUGAAGAUCTT | 489 | GAUCUUCAAAAGUGCCCAATT | 490 |
| 368 | 368-386 | UGGGCACUUUUGAAGAUCATT | 491 | UGAUCUUCAAAAGUGCCCATT | 492 |
| 369 | 369-387 | GGGCACUUUUGAAGAUCAUTT | 493 | AUGAUCUUCAAAAGUGCCCTT | 494 |
| 377 | 377-395 | UUGAAGAUCAUUUUCUCAGTT | 495 | CUGAGAAAAUGAUCUUCAATT | 496 |
| 379 | 379-397 | GAAGAUCAUUUUCUCAGCCTT | 497 | GGCUGAGAAAAUGAUCUUCTT | 498 |
| 380 | 380-398 | AAGAUCAUUUUCUCAGCCUTT | 499 | AGGCUGAGAAAAUGAUCUUTT | 500 |
| 385 | 385-403 | CAUUUUCUCAGCCUCCAGATT | 501 | UCUGGAGGCUGAGAAAAUGTT | 502 |
| 394 | 394-412 | AGCCUCCAGAGGAUGUUCATT | 503 | UGAACAUCCUCUGGAGGCUTT | 504 |
| 396 | 396-414 | CCUCCAGAGGAUGUUCAAUTT | 505 | AUUGAACAUCCUCUGGAGGTT | 506 |
| 397 | 397-415 | CUCCAGAGGAUGUUCAAUATT | 507 | UAUUGAACAUCCUCUGGAGTT | 508 |
| 401 | 401-419 | AGAGGAUGUUCAAUAACUGTT | 509 | CAGUUAUUGAACAUCCUCUTT | 510 |
| 403 | 403-421 | AGGAUGUUCAAUAACUGUGTT | 511 | CACAGUUAUUGAACAUCCUTT | 512 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 407 | 407-425 | UGUUCAAUAACUGUGAGGUTT | 513 | ACCUCACAGUUAUUGAACATT | 514 |
| 409 | 409-427 | UUCAAUAACUGUGAGGUGGTT | 515 | CCACCUCACAGUUAUUGAATT | 516 |
| 410 | 410-428 | UCAAUAACUGUGAGGUGGUTT | 517 | ACCACCUCACAGUUAUUGATT | 518 |
| 411 | 411-429 | CAAUAACUGUGAGGUGGUCTT | 519 | GACCACCUCACAGUUAUUGTT | 520 |
| 412 | 412-430 | AAUAACUGUGAGGUGGUCCTT | 521 | GGACCACCUCACAGUUAUUTT | 522 |
| 413 | 413-431 | AUAACUGUGAGGUGGUCCUTT | 523 | AGGACCACCUCACAGUUAUTT | 524 |
| 414 | 414-432 | UAACUGUGAGGUGGUCCUUTT | 525 | AAGGACCACCUCACAGUUATT | 526 |
| 416 | 416-434 | ACUGUGAGGUGGUCCUUGGTT | 527 | CCAAGGACCACCUCACAGUTT | 528 |
| 418 | 418-436 | UGUGAGGUGGUCCUUGGGATT | 529 | UCCCAAGGACCACCUCACATT | 530 |
| 419 | 419-437 | GUGAGGUGGUCCUUGGGAATT | 531 | UUCCCAAGGACCACCUCACTT | 532 |
| 425 | 425-443 | UGGUCCUUGGGAAUUUGGATT | 533 | UCCAAAUUCCCAAGGACCATT | 534 |
| 431 | 431-449 | UUGGGAAUUUGGAAAUUACTT | 535 | GUAAUUUCCAAAUUCCCAATT | 536 |
| 432 | 432-450 | UGGGAAUUUGGAAAUUACCTT | 537 | GGUAAUUUCCAAAUUCCCATT | 538 |
| 433 | 433-451 | GGGAAUUUGGAAAUUACCUTT | 539 | AGGUAAUUUCCAAAUUCCCTT | 540 |
| 434 | 434-452 | GGAAUUUGGAAAUUACCUATT | 541 | UAGGUAAUUUCCAAAUUCCTT | 542 |
| 458 | 458-476 | AGAGGAAUUAUGAUCUUUCTT | 543 | GAAAGAUCAUAAUUCCUCUTT | 544 |
| 459 | 459-477 | GAGGAAUUAUGAUCUUUCCTT | 545 | GGAAAGAUCAUAAUUCCUCTT | 546 |
| 463 | 463-481 | AAUUAUGAUCUUUCCUUCUTT | 547 | AGAAGGAAAGAUCAUAAUUTT | 548 |
| 464 | 464-482 | AUUAUGAUCUUUCCUUCUUTT | 549 | AAGAAGGAAAGAUCAUAAUTT | 550 |
| 466 | 466-484 | UAUGAUCUUUCCUUCUUAATT | 551 | UUAAGAAGGAAAGAUCAUATT | 552 |
| 468 | 468-486 | UGAUCUUUCCUUCUUAAAGTT | 553 | CUUUAAGAAGGAAAGAUCATT | 554 |
| 471 | 471-489 | UCUUUCCUUCUUAAAGACCTT | 555 | GGUCUUUAAGAAGGAAAGATT | 556 |
| 476 | 476-494 | CCUUCUUAAAGACCAUCCATT | 557 | UGGAUGGUCUUUAAGAAGGTT | 558 |
| 477 | 477-495 | CUUCUUAAAGACCAUCCAGTT | 559 | CUGGAUGGUCUUUAAGAAGTT | 560 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 479 | 479-497 | UCUUAAAGACCAUCCAGGATT | 561 | UCCUGGAUGGUCUUUAAGATT | 562 |
| 481 | 481-499 | UUAAAGACCAUCCAGGAGGTT | 563 | CCUCCUGGAUGGUCUUUAATT | 564 |
| 482 | 482-500 | UAAAGACCAUCCAGGAGGUTT | 565 | ACCUCCUGGAUGGUCUUUATT | 566 |
| 492 | 492-510 | CCAGGAGGUGGCUGGUUAUTT | 567 | AUAACCAGCCACCUCCUGGTT | 568 |
| 493 | 493-511 | CAGGAGGUGGCUGGUUAUGTT | 569 | CAUAACCAGCCACCUCCUGTT | 570 |
| 494 | 494-512 | AGGAGGUGGCUGGUUAUGUTT | 571 | ACAUAACCAGCCACCUCCUTT | 572 |
| 495 | 495-513 | GGAGGUGGCUGGUUAUGUCTT | 573 | GACAUAACCAGCCACCUCCTT | 574 |
| 496 | 496-514 | GAGGUGGCUGGUUAUGUCCTT | 575 | GGACAUAACCAGCCACCUCTT | 576 |
| 497 | 497-515 | AGGUGGCUGGUUAUGUCCUTT | 577 | AGGACAUAACCAGCCACCUTT | 578 |
| 499 | 499-517 | GUGGCUGGUUAUGUCCUCATT | 579 | UGAGGACAUAACCAGCCACTT | 580 |
| 520 | 520-538 | GCCCUCAACACAGUGGAGCTT | 581 | GCUCCACUGUGUUGAGGGCTT | 582 |
| 542 | 542-560 | UUCCUUUGGAAAACCUGCATT | 583 | UGCAGGUUUUCCAAAGGAATT | 584 |
| 543 | 543-561 | UCCUUUGGAAAACCUGCAGTT | 585 | CUGCAGGUUUUCCAAAGGATT | 586 |
| 550 | 550-568 | GAAAACCUGCAGAUCAUCATT | 587 | UGAUGAUCUGCAGGUUUUCTT | 588 |
| 551 | 551-569 | AAAACCUGCAGAUCAUCAGTT | 589 | CUGAUGAUCUGCAGGUUUUTT | 590 |
| 553 | 553-571 | AACCUGCAGAUCAUCAGAGTT | 591 | CUCUGAUGAUCUGCAGGUUTT | 592 |
| 556 | 556-574 | CUGCAGAUCAUCAGAGGAATT | 593 | UUCCUCUGAUGAUCUGCAGTT | 594 |
| 586 | 586-604 | GAAAAUUCCUAUGCCUUAGTT | 595 | CUAAGGCAUAGGAAUUUUCTT | 596 |
| 587 | 587-605 | AAAAUUCCUAUGCCUUAGCTT | 597 | GCUAAGGCAUAGGAAUUUUTT | 598 |
| 589 | 589-607 | AAUUCCUAUGCCUUAGCAGTT | 599 | CUGCUAAGGCAUAGGAAUUTT | 600 |
| 592 | 592-610 | UCCUAUGCCUUAGCAGUCUTT | 601 | AGACUGCUAAGGCAUAGGATT | 602 |
| 593 | 593-611 | CCUAUGCCUUAGCAGUCUUTT | 603 | AAGACUGCUAAGGCAUAGGTT | 604 |
| 594 | 594-612 | CUAUGCCUUAGCAGUCUUATT | 605 | UAAGACUGCUAAGGCAUAGTT | 606 |
| 596 | 596-614 | AUGCCUUAGCAGUCUUAUCTT | 607 | GAUAAGACUGCUAAGGCAUTT | 608 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 597 | 597-615 | UGCCUUAGCAGUCUUAUCUTT | 609 | AGAUAAGACUGCUAAGGCATT | 610 |
| 598 | 598-616 | GCCUUAGCAGUCUUAUCUATT | 611 | UAGAUAAGACUGCUAAGGCTT | 612 |
| 599 | 599-617 | CCUUAGCAGUCUUAUCUAATT | 613 | UUAGAUAAGACUGCUAAGGTT | 614 |
| 600 | 600-618 | CUUAGCAGUCUUAUCUAACTT | 615 | GUUAGAUAAGACUGCUAAGTT | 616 |
| 601 | 601-619 | UUAGCAGUCUUAUCUAACUTT | 617 | AGUUAGAUAAGACUGCUAATT | 618 |
| 602 | 602-620 | UAGCAGUCUUAUCUAACUATT | 619 | UAGUUAGAUAAGACUGCUATT | 620 |
| 603 | 603-621 | AGCAGUCUUAUCUAACUAUTT | 621 | AUAGUUAGAUAAGACUGCUTT | 622 |
| 604 | 604-622 | GCAGUCUUAUCUAACUAUGTT | 623 | CAUAGUUAGAUAAGACUGCTT | 624 |
| 605 | 605-623 | CAGUCUUAUCUAACUAUGATT | 625 | UCAUAGUUAGAUAAGACUGTT | 626 |
| 608 | 608-626 | UCUUAUCUAACUAUGAUGCTT | 627 | GCAUCAUAGUUAGAUAAGATT | 628 |
| 609 | 609-627 | CUUAUCUAACUAUGAUGCATT | 629 | UGCAUCAUAGUUAGAUAAGTT | 630 |
| 610 | 610-628 | UUAUCUAACUAUGAUGCAATT | 631 | UUGCAUCAUAGUUAGAUAATT | 632 |
| 611 | 611-629 | UAUCUAACUAUGAUGCAAATT | 633 | UUUGCAUCAUAGUUAGAUATT | 634 |
| 612 | 612-630 | AUCUAACUAUGAUGCAAAUTT | 635 | AUUUGCAUCAUAGUUAGAUTT | 636 |
| 613 | 613-631 | UCUAACUAUGAUGCAAAUATT | 637 | UAUUUGCAUCAUAGUUAGATT | 638 |
| 614 | 614-632 | CUAACUAUGAUGCAAAUAATT | 639 | UUAUUUGCAUCAUAGUUAGTT | 640 |
| 616 | 616-634 | AACUAUGAUGCAAAUAAAATT | 641 | UUUUAUUUGCAUCAUAGUUTT | 642 |
| 622 | 622-640 | GAUGCAAAUAAAACCGGACTT | 643 | GUCCGGUUUUAUUUGCAUCTT | 644 |
| 623 | 623-641 | AUGCAAAUAAAACCGGACUTT | 645 | AGUCCGGUUUUAUUUGCAUTT | 646 |
| 624 | 624-642 | UGCAAAUAAAACCGGACUGTT | 647 | CAGUCCGGUUUUAUUUGCATT | 648 |
| 626 | 626-644 | CAAAUAAAACCGGACUGAATT | 649 | UUCAGUCCGGUUUUAUUUGTT | 650 |
| 627 | 627-645 | AAAUAAAACCGGACUGAAGTT | 651 | CUUCAGUCCGGUUUUAUUUTT | 652 |
| 628 | 628-646 | AAUAAAACCGGACUGAAGGTT | 653 | CCUUCAGUCCGGUUUUAUUTT | 654 |
| 630 | 630-648 | UAAAACCGGACUGAAGGAGTT | 655 | CUCCUUCAGUCCGGUUUUATT | 656 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 631 | 631-649 | AAAACCGGACUGAAGGAGCTT | 657 | GCUCCUUCAGUCCGGUUUUTT | 658 |
| 632 | 632-650 | AAACCGGACUGAAGGAGCUTT | 659 | AGCUCCUUCAGUCCGGUUUTT | 660 |
| 633 | 633-651 | AACCGGACUGAAGGAGCUGTT | 661 | CAGCUCCUUCAGUCCGGUUTT | 662 |
| 644 | 644-662 | AGGAGCUGCCCAUGAGAAATT | 663 | UUUCUCAUGGGCAGCUCCUTT | 664 |
| 665 | 665-683 | UACAGGAAAUCCUGCAUGGTT | 665 | CCAUGCAGGAUUUCCUGUATT | 666 |
| 668 | 668-686 | AGGAAAUCCUGCAUGGCGCTT | 667 | GCGCCAUGCAGGAUUUCCUTT | 668 |
| 669 | 669-687 | GGAAAUCCUGCAUGGCGCCTT | 669 | GGCGCCAUGCAGGAUUUCCTT | 670 |
| 670 | 670-688 | GAAAUCCUGCAUGGCGCCGTT | 671 | CGGCGCCAUGCAGGAUUUCTT | 672 |
| 671 | 671-689 | AAAUCCUGCAUGGCGCCGUTT | 673 | ACGGCGCCAUGCAGGAUUUTT | 674 |
| 672 | 672-690 | AAUCCUGCAUGGCGCCGUGTT | 675 | CACGGCGCCAUGCAGGAUUTT | 676 |
| 674 | 674-692 | UCCUGCAUGGCGCCGUGCGTT | 677 | CGCACGGCGCCAUGCAGGATT | 678 |
| 676 | 676-694 | CUGCAUGGCGCCGUGCGGUTT | 679 | ACCGCACGGCGCCAUGCAGTT | 680 |
| 677 | 677-695 | UGCAUGGCGCCGUGCGGUUTT | 681 | AACCGCACGGCGCCAUGCATT | 682 |
| 678 | 678-696 | GCAUGGCGCCGUGCGGUUCTT | 683 | GAACCGCACGGCGCCAUGCTT | 684 |
| 680 | 680-698 | AUGGCGCCGUGCGGUUCAGTT | 685 | CUGAACCGCACGGCGCCAUTT | 686 |
| 681 | 681-699 | UGGCGCCGUGCGGUUCAGCTT | 687 | GCUGAACCGCACGGCGCCATT | 688 |
| 682 | 682-700 | GGCGCCGUGCGGUUCAGCATT | 689 | UGCUGAACCGCACGGCGCCTT | 690 |
| 683 | 683-701 | GCGCCGUGCGGUUCAGCAATT | 691 | UUGCUGAACCGCACGGCGCTT | 692 |
| 684 | 684-702 | CGCCGUGCGGUUCAGCAACTT | 693 | GUUGCUGAACCGCACGGCGTT | 694 |
| 685 | 685-703 | GCCGUGCGGUUCAGCAACATT | 695 | UGUUGCUGAACCGCACGGCTT | 696 |
| 686 | 686-704 | CCGUGCGGUUCAGCAACAATT | 697 | UUGUUGCUGAACCGCACGGTT | 698 |
| 688 | 688-706 | GUGCGGUUCAGCAACAACCTT | 699 | GGUUGUUGCUGAACCGCACTT | 700 |
| 690 | 690-708 | GCGGUUCAGCAACAACCCUTT | 701 | AGGGUUGUUGCUGAACCGCTT | 702 |
| 692 | 692-710 | GGUUCAGCAACAACCCUGCTT | 703 | GCAGGGUUGUUGCUGAACCTT | 704 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 698 | 698-716 | GCAACAACCCUGCCCUGUGTT | 705 | CACAGGGCAGGGUUGUUGCTT | 706 |
| 700 | 700-718 | AACAACCCUGCCCUGUGCATT | 707 | UGCACAGGGCAGGGUUGUTT | 708 |
| 719 | 719-737 | ACGUGGAGAGCAUCCAGUGTT | 709 | CACUGGAUGCUCUCCACGUTT | 710 |
| 720 | 720-738 | CGUGGAGAGCAUCCAGUGGTT | 711 | CCACUGGAUGCUCUCCACGTT | 712 |
| 721 | 721-739 | GUGGAGAGCAUCCAGUGGCTT | 713 | GCCACUGGAUGCUCUCCACTT | 714 |
| 724 | 724-742 | GAGAGCAUCCAGUGGCGGGTT | 715 | CCCGCCACUGGAUGCUCUCTT | 716 |
| 725 | 725-743 | AGAGCAUCCAGUGGCGGGATT | 717 | UCCCGCCACUGGAUGCUCUTT | 718 |
| 726 | 726-744 | GAGCAUCCAGUGGCGGGACTT | 719 | GUCCCGCCACUGGAUGCUCTT | 720 |
| 733 | 733-751 | CAGUGGCGGGACAUAGUCATT | 721 | UGACUAUGUCCCGCCACUGTT | 722 |
| 734 | 734-752 | AGUGGCGGGACAUAGUCAGTT | 723 | CUGACUAUGUCCCGCCACUTT | 724 |
| 736 | 736-754 | UGGCGGGACAUAGUCAGCATT | 725 | UGCUGACUAUGUCCCGCCATT | 726 |
| 737 | 737-755 | GGCGGGACAUAGUCAGCAGTT | 727 | CUGCUGACUAUGUCCCGCCTT | 728 |
| 763 | 763-781 | CUCAGCAACAUGUCGAUGGTT | 729 | CCAUCGACAUGUUGCUGAGTT | 730 |
| 765 | 765-783 | CAGCAACAUGUCGAUGGACTT | 731 | GUCCAUCGACAUGUUGCUGTT | 732 |
| 766 | 766-784 | AGCAACAUGUCGAUGGACUTT | 733 | AGUCCAUCGACAUGUUGCUTT | 734 |
| 767 | 767-785 | GCAACAUGUCGAUGGACUUTT | 735 | AAGUCCAUCGACAUGUUGCTT | 736 |
| 769 | 769-787 | AACAUGUCGAUGGACUUCCTT | 737 | GGAAGUCCAUCGACAUGUUTT | 738 |
| 770 | 770-788 | ACAUGUCGAUGGACUUCCATT | 739 | UGGAAGUCCAUCGACAUGUTT | 740 |
| 771 | 771-789 | CAUGUCGAUGGACUUCCAGTT | 741 | CUGGAAGUCCAUCGACAUGTT | 742 |
| 772 | 772-790 | AUGUCGAUGGACUUCCAGATT | 743 | UCUGGAAGUCCAUCGACAUTT | 744 |
| 775 | 775-793 | UCGAUGGACUUCCAGAACCTT | 745 | GGUUCUGGAAGUCCAUCGATT | 746 |
| 789 | 789-807 | GAACCACCUGGGCAGCUGCTT | 747 | GCAGCUGCCCAGGUGGUUCTT | 748 |
| 798 | 798-816 | GGGCAGCUGCCAAAAGUGUTT | 749 | ACACUUUUGGCAGCUGCCCTT | 750 |
| 800 | 800-818 | GCAGCUGCCAAAAGUGUGATT | 751 | UCACACUUUUGGCAGCUGCTT | 752 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 805 | 805-823 | UGCCAAAAGUGUGAUCCAATT | 753 | UUGGAUCACACUUUUGGCATT | 754 |
| 806 | 806-824 | GCCAAAAGUGUGAUCCAAGTT | 755 | CUUGGAUCACACUUUUGGCTT | 756 |
| 807 | 807-825 | CCAAAAGUGUGAUCCAAGCTT | 757 | GCUUGGAUCACACUUUUGGTT | 758 |
| 810 | 810-828 | AAAGUGUGAUCCAAGCUGUTT | 759 | ACAGCUUGGAUCACACUUUTT | 760 |
| 814 | 814-832 | UGUGAUCCAAGCUGUCCCATT | 761 | UGGGACAGCUUGGAUCACATT | 762 |
| 815 | 815-833 | GUGAUCCAAGCUGUCCCAATT | 763 | UUGGGACAGCUUGGAUCACTT | 764 |
| 817 | 817-835 | GAUCCAAGCUGUCCCAAUGTT | 765 | CAUUGGGACAGCUUGGAUCTT | 766 |
| 818 | 818-836 | AUCCAAGCUGUCCCAAUGGTT | 767 | CCAUUGGGACAGCUUGGAUTT | 768 |
| 819 | 819-837 | UCCAAGCUGUCCCAAUGGGTT | 769 | CCCAUUGGGACAGCUUGGATT | 770 |
| 820 | 820-838 | CCAAGCUGUCCCAAUGGGATT | 771 | UCCCAUUGGGACAGCUUGGTT | 772 |
| 821 | 821-839 | CAAGCUGUCCCAAUGGGAGTT | 773 | CUCCCAUUGGGACAGCUUGTT | 774 |
| 823 | 823-841 | AGCUGUCCCAAUGGGAGCUTT | 775 | AGCUCCCAUUGGGACAGCUTT | 776 |
| 826 | 826-844 | UGUCCCAAUGGGAGCUGCUTT | 777 | AGCAGCUCCCAUUGGGACATT | 778 |
| 847 | 847-865 | GGUGCAGGAGAGGAGAACUTT | 779 | AGUUCUCCUCUCCUGCACCTT | 780 |
| 871 | 871-889 | AAACUGACCAAAAUCAUCUTT | 781 | AGAUGAUUUUGGUCAGUUUTT | 782 |
| 872 | 872-890 | AACUGACCAAAAUCAUCUGTT | 783 | CAGAUGAUUUUGGUCAGUUTT | 784 |
| 873 | 873-891 | ACUGACCAAAAUCAUCUGUTT | 785 | ACAGAUGAUUUUGGUCAGUTT | 786 |
| 877 | 877-895 | ACCAAAAUCAUCUGUGCCCTT | 787 | GGGCACAGAUGAUUUUGGUTT | 788 |
| 878 | 878-896 | CCAAAAUCAUCUGUGCCCATT | 789 | UGGGCACAGAUGAUUUUGGTT | 790 |
| 881 | 881-899 | AAAUCAUCUGUGCCCAGCATT | 791 | UGCUGGGCACAGAUGAUUUTT | 792 |
| 890 | 890-908 | GUGCCCAGCAGUGCUCCGGTT | 793 | CCGGAGCACUGCUGGGCACTT | 794 |
| 892 | 892-910 | GCCCAGCAGUGCUCCGGGCTT | 795 | GCCCGGAGCACUGCUGGGCTT | 796 |
| 929 | 929-947 | CCAGUGACUGCUGCCACAATT | 797 | UUGUGGCAGCAGUCACUGGTT | 798 |
| 930 | 930-948 | CAGUGACUGCUGCCACAACTT | 799 | GUUGUGGCAGCAGUCACUGTT | 800 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 979 | 979-997 | GAGAGCGACUGCCUGGUCUTT | 801 | AGACCAGGCAGUCGCUCUCTT | 802 |
| 980 | 980-998 | AGAGCGACUGCCUGGUCUGTT | 803 | CAGACCAGGCAGUCGCUCUTT | 804 |
| 981 | 981-999 | GAGCGACUGCCUGGUCUGCTT | 805 | GCAGACCAGGCAGUCGCUCTT | 806 |
| 982 | 982-1000 | AGCGACUGCCUGGUCUGCCTT | 807 | GGCAGACCAGGCAGUCGCUTT | 808 |
| 983 | 983-1001 | GCGACUGCCUGGUCUGCCGTT | 809 | CGGCAGACCAGGCAGUCGCTT | 810 |
| 984 | 984-1002 | CGACUGCCUGGUCUGCCGCTT | 811 | GCGGCAGACCAGGCAGUCGTT | 812 |
| 989 | 989-1007 | GCCUGGUCUGCCGCAAAUUTT | 813 | AAUUUGCGGCAGACCAGGCTT | 814 |
| 990 | 990-1008 | CCUGGUCUGCCGCAAAUUCTT | 815 | GAAUUUGCGGCAGACCAGGTT | 816 |
| 991 | 991-1009 | CUGGUCUGCCGCAAAUUCCTT | 817 | GGAAUUUGCGGCAGACCAGTT | 818 |
| 992 | 992-1010 | UGGUCUGCCGCAAAUUCCGTT | 819 | CGGAAUUUGCGGCAGACCATT | 820 |
| 994 | 994-1012 | GUCUGCCGCAAAUUCCGAGTT | 821 | CUCGGAAUUUGCGGCAGACTT | 822 |
| 995 | 995-1013 | UCUGCCGCAAAUUCCGAGATT | 823 | UCUCGGAAUUUGCGGCAGATT | 824 |
| 996 | 996-1014 | CUGCCGCAAAUUCCGAGACTT | 825 | GUCUCGGAAUUUGCGGCAGTT | 826 |
| 997 | 997-1015 | UGCCGCAAAUUCCGAGACGTT | 827 | CGUCUCGGAAUUUGCGGCATT | 828 |
| 999 | 999-1017 | CCGCAAAUUCCGAGACGAATT | 829 | UUCGUCUCGGAAUUUGCGGTT | 830 |
| 1004 | 1004-1022 | AAUUCCGAGACGAAGCCACTT | 831 | GUGGCUUCGUCUCGGAAUUTT | 832 |
| 1005 | 1005-1023 | AUUCCGAGACGAAGCCACGTT | 833 | CGUGGCUUCGUCUCGGAAUTT | 834 |
| 1006 | 1006-1024 | UUCCGAGACGAAGCCACGUTT | 835 | ACGUGGCUUCGUCUCGGAATT | 836 |
| 1007 | 1007-1025 | UCCGAGACGAAGCCACGUGTT | 837 | CACGUGGCUUCGUCUCGGATT | 838 |
| 1008 | 1008-1026 | CCGAGACGAAGCCACGUGCTT | 839 | GCACGUGGCUUCGUCUCGGTT | 840 |
| 1010 | 1010-1028 | GAGACGAAGCCACGUGCAATT | 841 | UUGCACGUGGCUUCGUCUCTT | 842 |
| 1013 | 1013-1031 | ACGAAGCCACGUGCAAGGATT | 843 | UCCUUGCACGUGGCUUCGUTT | 844 |
| 1014 | 1014-1032 | CGAAGCCACGUGCAAGGACTT | 845 | GUCCUUGCACGUGGCUUCGTT | 846 |
| 1015 | 1015-1033 | GAAGCCACGUGCAAGGACATT | 847 | UGUCCUUGCACGUGGCUUCTT | 848 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1016 | 1016-1034 | AAGCCACGUGCAAGGACACTT | 849 | GUGUCCUUGCACGUGGCUUTT | 850 |
| 1040 | 1040-1058 | CCCCACUCAUGCUCUACAATT | 851 | UUGUAGAGCAUGAGUGGGGTT | 852 |
| 1042 | 1042-1060 | CCACUCAUGCUCUACAACCTT | 853 | GGUUGUAGAGCAUGAGUGGTT | 854 |
| 1044 | 1044-1062 | ACUCAUGCUCUACAACCCCTT | 855 | GGGGUUGUAGAGCAUGAGUTT | 856 |
| 1047 | 1047-1065 | CAUGCUCUACAACCCCACCTT | 857 | GGUGGGGUUGUAGAGCAUGTT | 858 |
| 1071 | 1071-1089 | CCAGAUGGAUGUGAACCCCTT | 859 | GGGGUUCACAUCCAUCUGGTT | 860 |
| 1073 | 1073-1091 | AGAUGGAUGUGAACCCCGATT | 861 | UCGGGGUUCACAUCCAUCUTT | 862 |
| 1074 | 1074-1092 | GAUGGAUGUGAACCCCGAGTT | 863 | CUCGGGGUUCACAUCCAUCTT | 864 |
| 1075 | 1075-1093 | AUGGAUGUGAACCCCGAGGTT | 865 | CCUCGGGGUUCACAUCCAUTT | 866 |
| 1077 | 1077-1095 | GGAUGUGAACCCCGAGGGCTT | 867 | GCCCUCGGGGUUCACAUCCTT | 868 |
| 1078 | 1078-1096 | GAUGUGAACCCCGAGGGCATT | 869 | UGCCCUCGGGGUUCACAUCTT | 870 |
| 1080 | 1080-1098 | UGUGAACCCCGAGGGCAAATT | 871 | UUUGCCCUCGGGGUUCACATT | 872 |
| 1084 | 1084-1102 | AACCCCGAGGGCAAAUACATT | 873 | UGUAUUUGCCCUCGGGGUUTT | 874 |
| 1085 | 1085-1103 | ACCCCGAGGGCAAAUACAGTT | 875 | CUGUAUUUGCCCUCGGGGUTT | 876 |
| 1087 | 1087-1105 | CCCGAGGGCAAAUACAGCUTT | 877 | AGCUGUAUUUGCCCUCGGTT | 878 |
| 1088 | 1088-1106 | CCGAGGGCAAAUACAGCUUTT | 879 | AAGCUGUAUUUGCCCUCGGTT | 880 |
| 1089 | 1089-1107 | CGAGGGCAAAUACAGCUUUTT | 881 | AAAGCUGUAUUUGCCCUCGTT | 882 |
| 1096 | 1096-1114 | AAAUACAGCUUUGGUGCCATT | 883 | UGGCACCAAAGCUGUAUUUTT | 884 |
| 1097 | 1097-1115 | AAUACAGCUUUGGUGCCACTT | 885 | GUGGCACCAAAGCUGUAUUTT | 886 |
| 1098 | 1098-1116 | AUACAGCUUUGGUGCCACCTT | 887 | GGUGGCACCAAAGCUGUAUTT | 888 |
| 1104 | 1104-1122 | CUUUGGUGCCACCUGCGUGTT | 889 | CACGCAGGUGGCACCAAAGTT | 890 |
| 1106 | 1106-1124 | UUGGUGCCACCUGCGUGAATT | 891 | UUCACGCAGGUGGCACCAATT | 892 |
| 1112 | 1112-1130 | CCACCUGCGUGAAGAAGUGTT | 893 | CACUUCUUCACGCAGGUGGTT | 894 |
| 1116 | 1116-1134 | CUGCGUGAAGAAGUGUCCCTT | 895 | GGGACACUUCUUCACGCAGTT | 896 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1117 | 1117-1135 | UGCGUGAAGAAGUGUCCCCUU | 897 | GGGGACACUUCUUCACGCAUU | 898 |
| 1118 | 1118-1136 | GCGUGAAGAAGUGUCCCCGUU | 899 | CGGGGACACUUCUUCACGCUU | 900 |
| 1119 | 1119-1137 | CGUGAAGAAGUGUCCCCGUUU | 901 | ACGGGGACACUUCUUCACGUU | 902 |
| 1120 | 1120-1138 | GUGAAGAAGUGUCCCCGUAUU | 903 | UACGGGGACACUUCUUCACUU | 904 |
| 1121 | 1121-1139 | UGAAGAAGUGUCCCCGUAAUU | 905 | UUACGGGGACACUUCUUCAUU | 906 |
| 1122 | 1122-1140 | GAAGAAGUGUCCCCGUAAUUU | 907 | AUUACGGGGACACUUCUUCUU | 908 |
| 1123 | 1123-1141 | AAGAAGUGUCCCCGUAAUUUU | 909 | AAUUACGGGGACACUUCUUUU | 910 |
| 1124 | 1124-1142 | AGAAGUGUCCCCGUAAUUAUU | 911 | UAAUUACGGGGACACUUCUUU | 912 |
| 1125 | 1125-1143 | GAAGUGUCCCCGUAAUUAUUU | 913 | AUAAUUACGGGGACACUUCUU | 914 |
| 1126 | 1126-1144 | AAGUGUCCCCGUAAUUAUGUU | 915 | CAUAAUUACGGGGACACUUUU | 916 |
| 1127 | 1127-1145 | AGUGUCCCCGUAAUUAUGUUU | 917 | ACAUAAUUACGGGGACACUUU | 918 |
| 1128 | 1128-1146 | GUGUCCCCGUAAUUAUGUGUU | 919 | CACAUAAUUACGGGGACACUU | 920 |
| 1129 | 1129-1147 | UGUCCCCGUAAUUAUGUGGUU | 921 | CCACAUAAUUACGGGGACAUU | 922 |
| 1130 | 1130-1148 | GUCCCCGUAAUUAUGUGGUUU | 923 | ACCACAUAAUUACGGGGACUU | 924 |
| 1132 | 1132-1150 | CCCCGUAAUUAUGUGGUGAUU | 925 | UCACCACAUAAUUACGGGGUU | 926 |
| 1134 | 1134-1152 | CCGUAAUUAUGUGGUGACAUU | 927 | UGUCACCACAUAAUUACGGUU | 928 |
| 1136 | 1136-1154 | GUAAUUAUGUGGUGACAGAUU | 929 | UCUGUCACCACAUAAUUACUU | 930 |
| 1137 | 1137-1155 | UAAUUAUGUGGUGACAGAUUU | 931 | AUCUGUCACCACAUAAUUAUU | 932 |
| 1138 | 1138-1156 | AAUUAUGUGGUGACAGAUCUU | 933 | GAUCUGUCACCACAUAAUUUU | 934 |
| 1139 | 1139-1157 | AUUAUGUGGUGACAGAUCAUU | 935 | UGAUCUGUCACCACAUAAUUU | 936 |
| 1140 | 1140-1158 | UUAUGUGGUGACAGAUCUCAUU | 937 | GUGAUCUGUCACCACAUAAUU | 938 |
| 1142 | 1142-1160 | AUGUGGUGACAGAUCACGUU | 939 | CCGUGAUCUGUCACCACAUU | 940 |
| 1145 | 1145-1163 | UGGUGACAGAUCACGGCUCUU | 941 | GAGCCGUGAUCUGUCACCAUU | 942 |
| 1147 | 1147-1165 | GUGACAGAUCACGGCUCGUUU | 943 | ACGAGCCGUGAUCUGUCACUU | 944 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1148 | 1148-1166 | UGACAGAUCACGGCUCGUGUTT | 945 | CACGAGCCGUGAUCUGUCATT | 946 |
| 1149 | 1149-1167 | GACAGAUCACGGCUCGUGCTT | 947 | GCACGAGCCGUGAUCUGUCTT | 948 |
| 1150 | 1150-1168 | ACAGAUCACGGCUCGUGCGTT | 949 | CGCACGAGCCGUGAUCUGUTT | 950 |
| 1151 | 1151-1169 | CAGAUCACGGCUCGUGCGUTT | 951 | ACGCACGAGCCGUGAUCUGTT | 952 |
| 1152 | 1152-1170 | AGAUCACGGCUCGUGCGUCTT | 953 | GACGCACGAGCCGUGAUCUTT | 954 |
| 1153 | 1153-1171 | GAUCACGGCUCGUGCGUCCTT | 955 | GGACGCACGAGCCGUGAUCTT | 956 |
| 1154 | 1154-1172 | AUCACGGCUCGUGCGUCCGTT | 957 | CGGACGCACGAGCCGUGAUTT | 958 |
| 1155 | 1155-1173 | UCACGGCUCGUGCGUCCGATT | 959 | UCGGACGCACGAGCCGUGATT | 960 |
| 1156 | 1156-1174 | CACGGCUCGUGCGUCCGAGTT | 961 | CUCGGACGCACGAGCCGUGTT | 962 |
| 1157 | 1157-1175 | ACGGCUCGUGCGUCCGAGCTT | 963 | GCUCGGACGCACGAGCCGUTT | 964 |
| 1160 | 1160-1178 | GCUCGUGCGUCCGAGCCUGTT | 965 | CAGGCUCGGACGCACGAGCTT | 966 |
| 1200 | 1200-1218 | GGAGGAAGACGGCGUCCGCTT | 967 | GCGGACGCCGUCUUCCUCCTT | 968 |
| 1201 | 1201-1219 | GAGGAAGACGGCGUCCGCATT | 969 | UGCGGACGCCGUCUUCCUCTT | 970 |
| 1203 | 1203-1221 | GGAAGACGGCGUCCGCAAGTT | 971 | CUUGCGGACGCCGUCUUCCTT | 972 |
| 1204 | 1204-1222 | GAAGACGGCGUCCGCAAGUTT | 973 | ACUUGCGGACGCCGUCUUCTT | 974 |
| 1205 | 1205-1223 | AAGACGGCGUCCGCAAGUGTT | 975 | CACUUGCGGACGCCGUCUUTT | 976 |
| 1207 | 1207-1225 | GACGGCGUCCGCAAGUGUATT | 977 | UACACUUGCGGACGCCGUCTT | 978 |
| 1208 | 1208-1226 | ACGGCGUCCGCAAGUGUAATT | 979 | UUACACUUGCGGACGCCGUTT | 980 |
| 1211 | 1211-1229 | GCGUCCGCAAGUGUAAGAATT | 981 | UUCUUACACUUGCGGACGCTT | 982 |
| 1212 | 1212-1230 | CGUCCGCAAGUGUAAGAAGTT | 983 | CUUCUUACACUUGCGGACGTT | 984 |
| 1213 | 1213-1231 | GUCCGCAAGUGUAAGAAGUTT | 985 | ACUUCUUACACUUGCGGACTT | 986 |
| 1214 | 1214-1232 | UCCGCAAGUGUAAGAAGUGTT | 987 | CACUUCUUACACUUGCGGATT | 988 |
| 1215 | 1215-1233 | CCGCAAGUGUAAGAAGUGCTT | 989 | GCACUUCUUACACUUGCGGTT | 990 |
| 1216 | 1216-1234 | CGCAAGUGUAAGAAGUGCGTT | 991 | CGCACUUCUUACACUUGCGTT | 992 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1217 | 1217-1235 | GCAAGUGUAAGAAGUGCGATT | 993 | UCGCACUUCUUACACUUGCTT | 994 |
| 1219 | 1219-1237 | AAGUGUAAGAAGUGCGAAGTT | 995 | CUUCGCACUUCUUACACUUTT | 996 |
| 1220 | 1220-1238 | AGUGUAAGAAGUGCGAAGGTT | 997 | CCUUCGCACUUCUUACACUTT | 998 |
| 1221 | 1221-1239 | GUGUAAGAAGUGCGAAGGGTT | 999 | CCCUUCGCACUUCUUACACTT | 1000 |
| 1222 | 1222-1240 | UGUAAGAAGUGCGAAGGGCTT | 1001 | GCCCUUCGCACUUCUUACATT | 1002 |
| 1223 | 1223-1241 | GUAAGAAGUGCGAAGGGCCTT | 1003 | GGCCCUUCGCACUUCUUACTT | 1004 |
| 1224 | 1224-1242 | UAAGAAGUGCGAAGGGCCUTT | 1005 | AGGCCCUUCGCACUUCUUATT | 1006 |
| 1225 | 1225-1243 | AAGAAGUGCGAAGGGCCUUTT | 1007 | AAGGCCCUUCGCACUUCUUTT | 1008 |
| 1226 | 1226-1244 | AGAAGUGCGAAGGGCCUUGTT | 1009 | CAAGGCCCUUCGCACUUCUTT | 1010 |
| 1229 | 1229-1247 | AGUGCGAAGGGCCUUGCCGTT | 1011 | CGGCAAGGCCCUUCGCACUTT | 1012 |
| 1230 | 1230-1248 | GUGCGAAGGGCCUUGCCGCTT | 1013 | GCGGCAAGGCCCUUCGCACTT | 1014 |
| 1231 | 1231-1249 | UGCGAAGGGCCUUGCCGCATT | 1015 | UGCGGCAAGGCCCUUCGCATT | 1016 |
| 1232 | 1232-1250 | GCGAAGGGCCUUGCCGCAATT | 1017 | UUGCGGCAAGGCCCUUCGCTT | 1018 |
| 1233 | 1233-1251 | CGAAGGGCCUUGCCGCAAATT | 1019 | UUUGCGGCAAGGCCCUUCGTT | 1020 |
| 1235 | 1235-1253 | AAGGGCCUUGCCGCAAAGUTT | 1021 | ACUUUGCGGCAAGGCCCUUTT | 1022 |
| 1236 | 1236-1254 | AGGGCCUUGCCGCAAAGUGTT | 1023 | CACUUUGCGGCAAGGCCCUTT | 1024 |
| 1237 | 1237-1255 | GGGCCUUGCCGCAAAGUGUTT | 1025 | ACACUUUGCGGCAAGGCCCTT | 1026 |
| 1238 | 1238-1256 | GGCCUUGCCGCAAAGUGUGTT | 1027 | CACACUUUGCGGCAAGGCCTT | 1028 |
| 1239 | 1239-1257 | GCCUUGCCGCAAAGUGUGUTT | 1029 | ACACACUUUGCGGCAAGGCTT | 1030 |
| 1241 | 1241-1259 | CUUGCCGCAAAGUGUGUAATT | 1031 | UUACACACUUUGCGGCAAGTT | 1032 |
| 1261 | 1261-1279 | GGAAUAGGUAUUGGUGAAUTT | 1033 | AUUCACCAAUACCUAUUCCTT | 1034 |
| 1262 | 1262-1280 | GAAUAGGUAUUGGUGAAUUTT | 1035 | AAUUCACCAAUACCUAUUCTT | 1036 |
| 1263 | 1263-1281 | AAUAGGUAUUGGUGAAUUUTT | 1037 | AAAUUCACCAAUACCUAUUTT | 1038 |
| 1264 | 1264-1282 | AUAGGUAUUGGUGAAUUUATT | 1039 | UAAAUUCACCAAUACCUAUTT | 1040 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1266 | 1266-1284 | AGGUAUUGGUGAAUUUAAATT | 1041 | UUUAAAUUCACCAAUACCUTT | 1042 |
| 1267 | 1267-1285 | GGUAUUGGUGAAUUUAAAGTT | 1043 | CUUUAAAUUCACCAAUACCTT | 1044 |
| 1289 | 1289-1307 | CACUCUCCAUAAAUGCUACTT | 1045 | GUAGCAUUUAUGGAGAGUGTT | 1046 |
| 1313 | 1313-1331 | UUAAACACUUCAAAAACUGTT | 1047 | CAGUUUUUGAAGUGUUUAATT | 1048 |
| 1320 | 1320-1338 | CUUCAAAAACUGCACCUCCTT | 1049 | GGAGGUGCAGUUUUUGAAGTT | 1050 |
| 1321 | 1321-1339 | UUCAAAAACUGCACCUCCATT | 1051 | UGGAGGUGCAGUUUUUGAATT | 1052 |
| 1322 | 1322-1340 | UCAAAAACUGCACCUCCAUTT | 1053 | AUGGAGGUGCAGUUUUUGATT | 1054 |
| 1323 | 1323-1341 | CAAAAACUGCACCUCCAUCTT | 1055 | GAUGGAGGUGCAGUUUUUGTT | 1056 |
| 1324 | 1324-1342 | AAAAACUGCACCUCCAUCATT | 1057 | UGAUGGAGGUGCAGUUUUUTT | 1058 |
| 1328 | 1328-1346 | ACUGCACCUCCAUCAGUGGTT | 1059 | CCACUGAUGGAGGUGCAGUTT | 1060 |
| 1332 | 1332-1350 | CACCUCCAUCAGUGGCGAUTT | 1061 | AUCGCCACUGAUGGAGGUGTT | 1062 |
| 1333 | 1333-1351 | ACCUCCAUCAGUGGCGAUCTT | 1063 | GAUCGCCACUGAUGGAGGUTT | 1064 |
| 1335 | 1335-1353 | CUCCAUCAGUGGCGAUCUCTT | 1065 | GAGAUCGCCACUGAUGGAGTT | 1066 |
| 1338 | 1338-1356 | CAUCAGUGGCGAUCUCCACTT | 1067 | GUGGAGAUCGCCACUGAUGTT | 1068 |
| 1344 | 1344-1362 | UGGCGAUCUCCACAUCCUGTT | 1069 | CAGGAUGUGGAGAUCGCCATT | 1070 |
| 1345 | 1345-1363 | GGCGAUCUCCACAUCCUGCTT | 1071 | GCAGGAUGUGGAGAUCGCCTT | 1072 |
| 1346 | 1346-1364 | GCGAUCUCCACAUCCUGCCTT | 1073 | GGCAGGAUGUGGAGAUCGCTT | 1074 |
| 1347 | 1347-1365 | CGAUCUCCACAUCCUGCCGTT | 1075 | CGGCAGGAUGUGGAGAUCGTT | 1076 |
| 1348 | 1348-1366 | GAUCUCCACAUCCUGCCGGTT | 1077 | CCGGCAGGAUGUGGAGAUCTT | 1078 |
| 1353 | 1353-1371 | CCACAUCCUGCCGGUGGCATT | 1079 | UGCCACCGGCAGGAUGUGGTT | 1080 |
| 1354 | 1354-1372 | CACAUCCUGCCGGUGGCAUTT | 1081 | AUGCCACCGGCAGGAUGUGTT | 1082 |
| 1355 | 1355-1373 | ACAUCCUGCCGGUGGCAUUTT | 1083 | AAUGCCACCGGCAGGAUGUTT | 1084 |
| 1357 | 1357-1375 | AUCCUGCCGGUGGCAUUUATT | 1085 | UAAAUGCCACCGGCAGGAUTT | 1086 |
| 1360 | 1360-1378 | CUGCCGGUGGCAUUUAGGGTT | 1087 | CCCUAAAUGCCACCGGCAGTT | 1088 |

TABLE 2-continued

EGFR siRNA Sequences

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1361 | 1361-1379 | UGCCGGUGGCAUUUAGGGGTT | 1089 | CCCCUAAAUGCCACCGGCATT | 1090 |
| 1362 | 1362-1380 | GCCGGUGGCAUUUAGGGGUTT | 1091 | ACCCCUAAAUGCCACCGGCTT | 1092 |
| 1363 | 1363-1381 | CCGGUGGCAUUUAGGGGUGTT | 1093 | CACCCCUAAAUGCCACCGGTT | 1094 |
| 1366 | 1366-1384 | GUGGCAUUUAGGGGUGACUTT | 1095 | AGUCACCCCUAAAUGCCACTT | 1096 |
| 1369 | 1369-1387 | GCAUUUAGGGGUGACUCCTT | 1097 | AGGAGUCACCCCUAAAUGCTT | 1098 |
| 1370 | 1370-1388 | CAUUUAGGGGUGACUCCUTT | 1099 | AAGGAGUCACCCCUAAAUGTT | 1100 |
| 1371 | 1371-1389 | AUUUAGGGGUGACUCCUUCTT | 1101 | GAAGGAGUCACCCCUAAAUTT | 1102 |
| 1372 | 1372-1390 | UUUAGGGGUGACUCCUUCATT | 1103 | UGAAGGAGUCACCCCUAAATT | 1104 |
| 1373 | 1373-1391 | UUAGGGGUGACUCCUUCACTT | 1105 | GUGAAGGAGUCACCCCUAATT | 1106 |
| 1374 | 1374-1392 | UAGGGGUGACUCCUUCACATT | 1107 | UGUGAAGGAGUCACCCCUATT | 1108 |
| 1404 | 1404-1422 | UCUGGAUCCACAGGAACUGTT | 1109 | CAGUUCCUGUGGAUCCAGATT | 1110 |
| 1408 | 1408-1426 | GAUCCACAGGAACUGGAUATT | 1111 | UAUCCAGUUCCUGUGGAUCTT | 1112 |
| 1409 | 1409-1427 | AUCCACAGGAACUGGAUAUTT | 1113 | AUAUCCAGUUCCUGUGGAUTT | 1114 |
| 1411 | 1411-1429 | CCACAGGAACUGGAUAUUCTT | 1115 | GAAUAUCCAGUUCCUGUGGTT | 1116 |
| 1412 | 1412-1430 | CACAGGAACUGGAUAUUCUTT | 1117 | AGAAUAUCCAGUUCCUGUGTT | 1118 |
| 1419 | 1419-1437 | ACUGGAUAUUCUGAAAACCTT | 1119 | GGUUUUCAGAAUAUCCAGUTT | 1120 |
| 1426 | 1426-1444 | AUUCUGAAAACCGUAAAGGTT | 1121 | CCUUUACGGUUUUCAGAAUTT | 1122 |
| 1427 | 1427-1445 | UUCUGAAAACCGUAAAGGATT | 1123 | UCCUUUACGGUUUUCAGAATT | 1124 |
| 1430 | 1430-1448 | UGAAAACCGUAAAGGAAAUTT | 1125 | AUUUCCUUUACGGUUUUCATT | 1126 |
| 1431 | 1431-1449 | GAAAACCGUAAAGGAAAUCTT | 1127 | GAUUUCCUUUACGGUUUUCTT | 1128 |

TABLE 3

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 68 | 68-86 | cgGfcCfgGfaGfuCfcCfgAfgCfuAfdTsdT | 1129 | UfAfgCfuCfgGfgAfcUfcCfgGfcCfgdTsdT | 1130 |
| 71 | 71-89 | ccGfgAfgUfcCfcGfaGfcUfaGfcCfdTsdT | 1131 | GfGfcUfaGfcUfcGfgGfaCfuCfcGfgdTsdT | 1132 |
| 72 | 72-90 | cgGfaGfuCfcCfgAfgCfuAfgCfcCfdTsdT | 1133 | GfGfgCfuAfgCfuCfgGfgAfcUfcCfgdTsdT | 1134 |
| 73 | 73-91 | ggAfgUfcCfcGfaGfcUfaGfcCfcCfdTsdT | 1135 | GfGfgCfuAfgCfuCfgGfgAfcfuCfcdTsdT | 1136 |
| 74 | 74-92 | gaGfuCfcCfgAfgCfuAfgCfcCfcGfdTsdT | 1137 | CfGfgGfcUfaGfcUfcGfgGfAfcUfcdTsdT | 1138 |
| 75 | 75-93 | agUfcCfcGfaGfcUfaGfcCfcCfgGfdTsdT | 1139 | CfCfgGfgCfuAfgCfuCfgGfgAfcUfudTsdT | 1140 |
| 76 | 76-94 | guCfcCfgAfgCfuAfgCfcCfcGfgCfdTsdT | 1141 | GfCfcGfgGfgCfuAfgCfuCfgGfgAfcdTsdT | 1142 |
| 78 | 78-96 | ccCfgAfgCfuAfgCfcCfcGfgCfgGfdTsdT | 1143 | CfCfgCfcGfgGfgCfuAfgCfuCfgGfgdTsdT | 1144 |
| 114 | 114-132 | ggAfcGfaCfaGfgCfcAfcCfuCfgUfdTsdT | 1145 | AfCfgAfgGfuGfgCfcUfgUfcGfuCfcdTsdT | 1146 |
| 115 | 115-133 | gaCfgAfcAfgGfcCfaCfcUfcGfuCfdTsdT | 1147 | GfAfcGfaGfgUfgGfcCfuGfuCfgUfcdTsdT | 1148 |
| 116 | 116-134 | acGfaCfaGfgCfcAfcCfuCfgUfcGfdTsdT | 1149 | CfGfaCfgAfgGfuGfgCfcUfgUfcGfudTsdT | 1150 |
| 117 | 117-135 | cgAfcAfgGfcCfaCfcUfcGfuCfgGfdTsdT | 1151 | CfCfgAfcGfaGfgUfgGfcCfuGfuCfgdTsdT | 1152 |
| 118 | 118-136 | gaCfaGfgCfcAfcCfuCfgUfcGfgCfdTsdT | 1153 | GfCfcGfaCfgAfgGfuGfgCfcUfgUfcdTsdT | 1154 |
| 120 | 120-138 | caGfgCfcAfcCfuCfgUfcGfgCfgUfdTsdT | 1155 | AfCfgCfcGfaCfgAfgGfuGfgCfcUfgdTsdT | 1156 |
| 121 | 121-139 | agGfcCfaCfcUfcGfuCfgGfcGfuCfdTsdT | 1157 | GfAfcGfcCfgAfcGfaGfgUfgGfcCfudTsdT | 1158 |
| 122 | 122-140 | ggCfcAfcCfuCfgUfcGfgCfgUfcCfdTsdT | 1159 | GfGfaCfgCfcGfaCfgAfgGfuGfgCfdTsdT | 1160 |
| 123 | 123-141 | gcCfaCfcUfcGfuCfgGfcGfuCfcGfdTsdT | 1161 | CfGfgAfcGfcCfgAfcGfaGfgUfgGfdTsdT | 1162 |
| 124 | 124-142 | ccAfcCfuCfgUfcGfgCfgUfcCfgCfdTsdT | 1163 | GfCfgGfaCfgCfcGfaCfgAfgGfuGfdTsdT | 1164 |
| 125 | 125-143 | caCfcUfcGfuCfgGfcGfuCfcGfcCfdTsdT | 1165 | GfGfcGfgAfcGfcCfgAfcGfaGfgUfdTsdT | 1166 |
| 126 | 126-144 | acCfuCfgUfcGfgCfgUfcCfgCfcCfdTsdT | 1167 | GfGfgCfgGfaCfgCfcGfaCfgAfgGfudTsdT | 1168 |
| 127 | 127-145 | ccUfcGfuCfgGfcGfuCfcGfcCfgCfdTsdT | 1169 | CfGfgCfgGfaCfgCfcGfaCfgAfgGfdTsdT | 1170 |
| 128 | 128-146 | cuCfgUfcGfgCfgUfcCfgCfcCfgAfdTsdT | 1171 | UfCfgGfgCfgGfaCfgCfcGfaCfgAfgdTsdT | 1172 |
| 129 | 129-147 | ucGfuCfgGfcGfuCfcGfcCfcGfaGfdTsdT | 1173 | CfUfcGfgGfcGfgAfcGfcCfgAfcGfadTsdT | 1174 |
| 130 | 130-148 | cgUfcGfgCfgUfcCfgCfcCfgAfgUfdTsdT | 1175 | AfCfuCfgGfgCfgGfaCfgCfcGfaCfdTsdT | 1176 |
| 131 | 131-149 | guCfgGfcGfuCfcGfcCfcGfaGfuCfdTsdT | 1177 | GfAfcUfcGfgGfcGfgAfcGfcCfgAfcdTsdT | 1178 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 132 | 132-150 | ucGfgCfgUfcCfgCfcCfgAfgUfcCfdTsdT | 1179 | GfGfaCfuCfgGfgCfgGfaCfgCfcGfadTsdT | 1180 |
| 135 | 135-153 | gcGfuCfcGfcCfcGfaGfuCfcCfcGfdTsdT | 1181 | CfGfgGfgAfcUfcGfgGfcGfgAfcGfcdTsdT | 1182 |
| 136 | 136-154 | cgUfcCfgCfcCfgAfgUfcCfcCfgCfdTsdT | 1183 | GfCfgGfgGfaCfuCfgGfgCfgGfaCfgdTsdT | 1184 |
| 141 | 141-159 | gcCfcGfaGfuCfcCfcGfcCfuCfgCfdTsdT | 1185 | GfCfgAfgGfcGfgGfgAfcUfcGfgGfcdTsdT | 1186 |
| 164 | 164-182 | aaCfgCfcAfcAfaCfcAfcCfgCfgCfdTsdT | 1187 | GfCfgCfgGfuGfuUfuGfuGfgCfgUfudTsdT | 1188 |
| 165 | 165-183 | acGfcCfaCfaAfcCfaCfcGfcGfcAfdTsdT | 1189 | UfGfcGfcGfgUfgGfuUfgUfgGfcGfudTsdT | 1190 |
| 166 | 166-184 | cgCfcAfcAfaCfcAfcCfgCfgCfaCfdTsdT | 1191 | GfUfgCfgCfgGfuGfgUfuGfuGfgCfgdTsdT | 1192 |
| 168 | 168-186 | ccAfcAfaCfcAfcCfgCfgCfaCfgGfdTsdT | 1193 | CfCfgUfgCfgCfgGfuGfgUfuGfuGfgdTsdT | 1194 |
| 169 | 169-187 | caCfaAfcCfaCfcGfcGfcAfcGfgCfdTsdT | 1195 | GfCfcGfuGfcGfcGfgUfgGfuUfgUfgdTsdT | 1196 |
| 170 | 170-188 | acAfaCfcAfcCfgCfgCfaCfgGfcCfdTsdT | 1197 | GfGfcCfgUfgCfgCfgGfuGfgUfuGfudTsdT | 1198 |
| 247 | 247-265 | auGfcGfaCfcCfuCfcGfgGfaCfgGfdTsdT | 1199 | CfCfgUfcCfcGfgAfgGfgUfcGfcAfudTsdT | 1200 |
| 248 | 248-266 | ugCfgAfcCfcUfcCfgGfgAfcGfgGfdTsdT | 1201 | GfCfcGfuCfcCfgGfaGfgGfuCfgCfadTsdT | 1202 |
| 249 | 249-267 | gcGfaCfcCfuCfcGfgGfaCfgGfcCfdTsdT | 1203 | GfGfcCfgUfcCfcGfgAfgGfgUfcGfcdTsdT | 1204 |
| 251 | 251-269 | gaCfcCfuCfcGfgGfaCfgGfcCfgGfdTsdT | 1205 | CfCfgGfcCfgUfcCfcGfgAfgGfgUfcdTsdT | 1206 |
| 252 | 252-270 | acCfcUfcCfgGfgAfcGfgCfcGfgGfdTsdT | 1207 | CfCfcGfgCfcGfuCfcCfgGfaGfgGfudTsdT | 1208 |
| 254 | 254-272 | ccUfcCfgGfgAfcGfgCfcGfgGfgCfdTsdT | 1209 | GfCfcCfcGfgCfcGfuCfcCfgGfaGfgdTsdT | 1210 |
| 329 | 329-347 | agAfaAfgUfuUfgCfcAfaGfgCfaCfdTsdT | 1211 | GfUfgCfcUfuGfgCfaAfaCfuUfuCfudTsdT | 1212 |
| 330 | 330-348 | gaAfaGfuUfuGfcCfaAfgGfcAfcGfdTsdT | 1213 | CfGfuGfcCfuUfgGfcAfaAfcUfuUfcdTsdT | 1214 |
| 332 | 332-350 | aaGfuUfuGfcCfaAfgGfcAfcGfaGfdTsdT | 1215 | CfUfcGfuGfcCfuUfgGfcAfaAfcUfudTsdT | 1216 |
| 333 | 333-351 | agUfuUfgCfcAfaGfgCfaCfgAfgUfdTsdT | 1217 | AfCfuCfgUfgCfcUfuGfgCfaAfaCfudTsdT | 1218 |
| 334 | 334-352 | guUfuGfcCfaAfgGfcAfcGfaGfuAfdTsdT | 1219 | UfAfcUfcGfuGfcCfuUfgGfcAfaAfcdTsdT | 1220 |
| 335 | 335-353 | uuUfgCfcAfaGfgCfaCfgAfgUfaAfdTsdT | 1221 | UfUfaCfuCfgUfgCfcUfuGfgCfaAfadTsdT | 1222 |
| 336 | 336-354 | uuGfcCfaAfgGfcAfcGfaGfuAfaCfdTsdT | 1223 | GfUfuAfcUfcGfuGfcCfuUfgGfcAfadTsdT | 1224 |
| 337 | 337-355 | ugCfcAfaGfgCfaCfgAfgUfaAfcAfdTsdT | 1225 | UfGfuUfaCfuCfgUfgCfcUfuGfgCfadTsdT | 1226 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 338 | 338-356 | gcCfaAfgGfcAfcGfaGfuAfaCfaAfdTsdT | 1227 | UfUfgUfuAfcUfcGfuGfcCfuUfgGfcdTsdT | 1228 |
| 361 | 361-379 | acGfcAfgUfuGfgGfcAfcUfuUfuGfdTsdT | 1229 | CfAfaAfaGfuGfcCfcAfaCfuGfcGfudTsdT | 1230 |
| 362 | 362-380 | cgCfaGfuUfgGfgCfaCfuUfuUfgAfdTsdT | 1231 | UfCfaAfaAfgUfgCfcCfaAfcUfgCfgdTsdT | 1232 |
| 363 | 363-381 | gcAfgUfuGfgGfcAfcUfuUfuGfaAfdTsdT | 1233 | UfUfcAfaAfaGfuGfcCfcAfaCfuGfcdTsdT | 1234 |
| 364 | 364-382 | caGfuUfgGfgCfaCfuUfuUfgAfaGfdTsdT | 1235 | CfUfuCfaAfaAfgUfgCfcCfaAfcUfgdTsdT | 1236 |
| 365 | 365-383 | agUfuGfgGfcAfcUfuUfuGfaAfgAfdTsdT | 1237 | UfCfuUfcAfaAfaGfuGfcCfcAfaCfudTsdT | 1238 |
| 366 | 366-384 | guUfgGfgCfaCfuUfuUfgAfaGfaUfdTsdT | 1239 | AfUfcUfuCfaAfaAfgUfgCfcCfaAfcdTsdT | 1240 |
| 367 | 367-385 | uuGfgGfcAfcUfuUfuGfaAfgAfuCfdTsdT | 1241 | GfAfuCfuUfcAfaAfaGfuGfcCfcAfadTsdT | 1242 |
| 368 | 368-386 | ugGfgCfaCfuUfuUfgAfaGfaUfcAfdTsdT | 1243 | UfGfaUfcUfuCfaAfaAfgUfgCfcCfadTsdT | 1244 |
| 369 | 369-387 | ggGfcAfcUfuUfuGfaAfgAfuCfaUfdTsdT | 1245 | AfUfgAfuCfuUfcAfaAfaGfuGfcCfcdTsdT | 1246 |
| 377 | 377-395 | uuGfaAfgAfuCfaUfuUfuCfuCfaGfdTsdT | 1247 | CfUfgAfgAfaAfaUfgAfuCfuUfcAfadTsdT | 1248 |
| 379 | 379-397 | gaAfgAfuCfaUfuUfuCfuCfaGfcCfdTsdT | 1249 | GfGfcUfgAfgAfaAfaUfgAfuCfuUfcdTsdT | 1250 |
| 380 | 380-398 | aaGfaUfcAfuUfuUfcUfcAfgCfcUfdTsdT | 1251 | AfGfgCfuGfaGfaAfaAfuGfaUfcUfudTsdT | 1252 |
| 385 | 385-403 | caUfuUfuCfuCfaGfcCfuCfcAfgAfdTsdT | 1253 | UfCfuGfgAfgGfcUfgAfgAfaAfaUfgdTsdT | 1254 |
| 394 | 394-412 | agCfcUfcCfaGfaGfgAfuGfuUfcAfdTsdT | 1255 | UfGfaAfcAfuCfcUfcUfgGfaGfgCfudTsdT | 1256 |
| 396 | 396-414 | ccUfcCfaGfaGfgAfuGfuUfcAfaUfdTsdT | 1257 | AfUfuGfaAfcAfuCfcUfcUfgGfaGfgdTsdT | 1258 |
| 397 | 397-415 | cuCfcAfgAfgGfaUfgUfuCfaAfuAfdTsdT | 1259 | UfAfuUfgAfaCfaUfcCfuCfuGfgAfgdTsdT | 1260 |
| 401 | 401-419 | agAfgGfaUfgUfuCfaAfuAfaCfuGfdTsdT | 1261 | CfAfgUfuAfuUfgAfaCfaUfcCfuCfudTsdT | 1262 |
| 403 | 403-421 | agGfaUfgUfuCfaAfuAfaCfuGfuGfdTsdT | 1263 | CfAfcAfgUfuAfuUfgAfaCfaUfcCfudTsdT | 1264 |
| 407 | 407-425 | ugUfuCfaAfuAfaCfuGfuGfaGfgUfdTsdT | 1265 | AfCfcUfcAfcAfgUfuAfuUfgAfaCfadTsdT | 1266 |
| 409 | 409-427 | uuCfaAfuAfaCfuGfuGfaGfgUfgGfdTsdT | 1267 | CfCfaCfcUfcAfcAfgUfuAfuUfgAfadTsdT | 1268 |
| 410 | 410-428 | ucAfaUfaAfcUfgUfgAfgGfuGfgUfdTsdT | 1269 | AfCfcAfcCfuCfaCfaGfuUfaUfuGfadTsdT | 1270 |
| 411 | 411-429 | caAfuAfaCfuGfuGfaGfgUfgGfuCfdTsdT | 1271 | GfAfcCfaCfcUfcAfcAfgUfuAfuUfgdTsdT | 1272 |
| 412 | 412-430 | aaUfaAfcUfgUfgAfgGfuGfgUfcCfdTsdT | 1273 | GfGfaCfcAfcCfuCfaCfaGfuUfaUfudTsdT | 1274 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 413 | 413-431 | auAfaCfuGfuGfaGfgUfgGfuCfcUfdTsdT | 1275 | AfGfgAfcCfaCfcUfcAfcAfgUfuAfudTsdT | 1276 |
| 414 | 414-432 | uaAfcUfgUfgAfgGfuGfgUfcCfuUfdTsdT | 1277 | AfAfgGfaCfcAfcCfuCfaCfaGfuUfadTsdT | 1278 |
| 416 | 416-434 | acUfgUfgAfgGfuGfgUfcCfuUfgGfdTsdT | 1279 | CfCfaAfgGfaCfcAfcCfuCfaCfaGfudTsdT | 1280 |
| 418 | 418-436 | ugUfgAfgGfuGfgUfcCfuUfgGfgAfdTsdT | 1281 | UfCfcCfaAfgGfaCfcAfcCfuCfaCfadTsdT | 1282 |
| 419 | 419-437 | guGfaGfgUfgGfuCfcUfuGfgGfaAfdTsdT | 1283 | UfUfcCfcAfaGfgAfcCfaCfcUfcAfcdTsdT | 1284 |
| 425 | 425-443 | ugGfuCfcUfuGfgGfaAfuUfuGfgAfdTsdT | 1285 | UfCfcAfaAfuUfcCfcAfaGfgAfcCfadTsdT | 1286 |
| 431 | 431-449 | uuGfgGfaAfuUfuGfgAfaAfuUfaCfdTsdT | 1287 | GfUfaAfuUfuCfcAfaAfuUfcCfcAfadTsdT | 1288 |
| 432 | 432-450 | ugGfgAfaUfuUfgGfaAfaUfuAfcCfdTsdT | 1289 | GfGfuAfaUfuUfcCfaAfaUfuCfcCfadTsdT | 1290 |
| 433 | 433-451 | ggGfaAfuUfuGfgAfaAfuUfaCfcUfdTsdT | 1291 | AfGfgUfaAfuUfuCfcAfaAfuUfcCfcdTsdT | 1292 |
| 434 | 434-452 | ggAfaUfuUfgGfaAfaUfuAfcCfuAfdTsdT | 1293 | UfAfgGfuAfaUfuUfcCfaAfaUfuCfcdTsdT | 1294 |
| 458 | 458-476 | agAfgGfaAfuUfaUfgAfuCfuUfuCfdTsdT | 1295 | GfAfaAfgAfuCfaUfaAfuUfcCfuCfudTsdT | 1296 |
| 459 | 459-477 | gaGfgAfaUfuAfuGfaUfcUfuUfcCfdTsdT | 1297 | GfGfaAfaGfaUfcAfuAfaUfuCfcUfcdTsdT | 1298 |
| 463 | 463-481 | aaUfuAfuGfaUfcUfuUfcCfuUfcUfdTsdT | 1299 | AfGfaAfgGfaAfaGfaUfcAfuAfaUfudTsdT | 1300 |
| 464 | 464-482 | auUfaUfgAfuCfuUfuCfcUfuCfuUfdTsdT | 1301 | AfAfgAfaGfgAfaAfgAfuCfaUfaAfudTsdT | 1302 |
| 466 | 466-484 | uaUfgAfuCfuUfuCfcUfuCfuUfaAfdTsdT | 1303 | UfUfaAfgAfaGfgAfaAfgAfuCfaUfadTsdT | 1304 |
| 468 | 468-486 | ugAfuCfuUfuCfcUfuCfuUfaAfaGfdTsdT | 1305 | CfUfuUfaAfgAfaGfgAfaAfgAfuCfadTsdT | 1306 |
| 471 | 471-489 | ucUfuUfcCfuUfcUfuAfaAfgAfcCfdTsdT | 1307 | GfGfuCfuUfuAfaGfaAfgGfaAfaGfadTsdT | 1308 |
| 476 | 476-494 | ccUfuCfuUfaAfaGfaCfcAfuCfcAfdTsdT | 1309 | UfGfgAfuGfgUfcUfuUfaAfgAfaGfgdTsdT | 1310 |
| 477 | 477-495 | cuUfcUfuAfaAfgAfcCfaUfcCfaGfdTsdT | 1311 | CfUfgGfaUfgGfuCfuUfuAfaGfaAfgdTsdT | 1312 |
| 479 | 479-497 | ucUfuAfaAfgAfcCfaUfcCfaGfdTsdT | 1313 | UfCfcUfgGfaUfgGfuCfuUfuAfaGfadTsdT | 1314 |
| 481 | 481-499 | uuAfaAfgAfcCfaUfcCfaGfgAfgGfdTsdT | 1315 | CfCfuCfcUfgGfaUfgGfuCfuUfuAfadTsdT | 1316 |
| 482 | 482-500 | uaAfaGfaCfcAfuCfcAfgGfaGfgUfdTsdT | 1317 | AfCfcUfcCfuGfgAfuGfgUfcUfuUfadTsdT | 1318 |
| 492 | 492-510 | ccAfgGfaGfgUfgGfcUfgGfuUfaUfdTsdT | 1319 | AfUfaAfcCfaGfcCfaCfcUfcCfuGfgdTsdT | 1320 |
| 493 | 493-511 | caGfgAfgGfuGfgCfuGfgUfuAfuGfdTsdT | 1321 | CfAfuAfaCfcAfgCfcAfcCfuCfcUfgdTsdT | 1322 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 494 | 494-512 | agGfaGfgUfgGfcUfgGfuUfaUfgUfdTsdT | 1323 | AfCfaUfaAfcCfaGfcCfaCfcUfcCfudTsdT | 1324 |
| 495 | 495-513 | ggAfgGfuGfgCfuGfgUfuAfuGfuCfdTsdT | 1325 | GfAfcAfuAfaCfcAfgCfcAfcCfuCfcdTsdT | 1326 |
| 496 | 496-514 | gaGfgUfgGfcUfgGfuUfaUfgUfcCfdTsdT | 1327 | GfGfaCfaUfaAfcCfaGfcCfaCfcUfcdTsdT | 1328 |
| 497 | 497-515 | agGfuGfgCfuGfgUfuAfuGfuCfcUfdTsdT | 1329 | AfGfgAfcAfuAfaCfcAfgCfcAfcCfudTsdT | 1330 |
| 499 | 499-517 | guGfgCfuGfgUfuAfuGfuCfcUfcAfdTsdT | 1331 | UfGfaGfgAfcAfuAfaCfcAfgCfcAfcdTsdT | 1332 |
| 520 | 520-538 | gcCfcUfcAfaCfaCfaGfuGfgAfgCfdTsdT | 1333 | GfCfcUfcCfcAfcUfgUfgUfuGfaGfgGfcdTsdT | 1334 |
| 542 | 542-560 | uuCfcUfuUfgGfaAfaAfcCfuGfcAfdTsdT | 1335 | UfGfcAfgGfuUfuUfcCfaAfaGfgAfadTsdT | 1336 |
| 543 | 543-561 | ucCfuUfuGfgAfaAfaCfcUfgCfaGfdTsdT | 1337 | CfUfgCfaGfgUfuUfuCfcAfaAfgGfadTsdT | 1338 |
| 550 | 550-568 | gaAfaAfcCfuGfcAfgAfuCfaUfcAfdTsdT | 1339 | UfGfaUfgAfuCfuGfcAfgGfuUfuUfcdTsdT | 1340 |
| 551 | 551-569 | aaAfaCfcUfgCfaGfaUfcAfuCfaGfdTsdT | 1341 | CfUfgAfuGfaUfcUfgCfaGfgUfuUfudTsdT | 1342 |
| 553 | 553-571 | aaCfcUfgCfaGfaUfcAfuCfaGfaGfdTsdT | 1343 | CfUfcUfgAfuGfaUfcUfgCfaGfgUfudTsdT | 1344 |
| 556 | 556-574 | cuGfcAfgGfaUfcAfuCfaGfgAfgGfaAfdTsdT | 1345 | UfUfcCfuCfuGfaUfgAfuCfuGfcAfgdTsdT | 1346 |
| 586 | 586-604 | gaAfaAfuUfcCfuAfuGfcCfuUfaGfdTsdT | 1347 | CfUfaAfgGfcAfuAfgGfaAfuUfuUfcdTsdT | 1348 |
| 587 | 587-605 | aaAfaUfuCfcUfaUfgCfcUfuAfgCfdTsdT | 1349 | GfCfuAfaGfgCfaUfaGfgAfaUfuUfudTsdT | 1350 |
| 589 | 589-607 | aaUfuCfcUfaUfgCfcUfuAfgCfaGfdTsdT | 1351 | CfUfgCfuAfaGfgCfaUfaGfgAfaUfudTsdT | 1352 |
| 592 | 592-610 | ucCfuAfuGfcCfuUfaGfcAfgUfcUfdTsdT | 1353 | AfGfaCfuGfcUfaAfgGfcAfuAfgGfadTsdT | 1354 |
| 593 | 593-611 | ccUfaUfgCfcUfuAfgCfaGfuCfuUfdTsdT | 1355 | AfAfgAfcUfgCfuAfaGfgCfaUfaGfgdTsdT | 1356 |
| 594 | 594-612 | cuAfuGfcCfuUfaGfcAfgUfcUfuAfdTsdT | 1357 | UfAfaGfaCfuGfcUfaAfgGfcAfuAfgdTsdT | 1358 |
| 596 | 596-614 | auGfcCfuUfaGfcAfgUfcUfuAfuCfdTsdT | 1359 | GfAfuAfaGfaCfuGfcUfaAfgGfcAfudTsdT | 1360 |
| 597 | 597-615 | ugCfcUfuAfgCfaGfuCfuUfaUfcUfdTsdT | 1361 | AfGfaUfaAfgAfcUfgCfuAfaGfgCfadTsdT | 1362 |
| 598 | 598-616 | gcCfuUfaGfcAfgUfcUfuAfuCfuAfdTsdT | 1363 | UfAfgAfuAfaGfaCfuGfcUfaAfgGfcdTsdT | 1364 |
| 599 | 599-617 | ccUfuAfgCfaGfuCfuUfaUfcUfaAfdTsdT | 1365 | UfUfaGfaUfaAfgAfcUfgCfuAfaGfgdTsdT | 1366 |
| 600 | 600-618 | cuUfaGfcAfgUfcUfuAfuCfuAfaCfdTsdT | 1367 | GfUfuAfgAfuAfaGfaCfuGfcUfaAfgdTsdT | 1368 |
| 601 | 601-619 | uuAfgCfaGfuCfuUfaUfcUfaAfcUfdTsdT | 1369 | AfGfuUfaGfaUfaAfgAfcUfgCfuAfadTsdT | 1370 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 602 | 602-620 | uaGfcAfgUfcUfuAfuCfuAfaCfuAfdTsdT | 1371 | UfAfgUfuAfgAfuAfaGfaCfuGfcUfadTsdT | 1372 |
| 603 | 603-621 | agCfaGfuCfuUfaUfcUfaAfcUfaUfdTsdT | 1373 | AfUfaGfuUfaGfaUfaAfgAfcUfgCfudTsdT | 1374 |
| 604 | 604-622 | gcAfgUfcUfuAfuCfuAfaCfuAfuGfdTsdT | 1375 | CfAfuAfgUfuAfgAfuAfaGfaCfuGfcdTsdT | 1376 |
| 605 | 605-623 | caGfuCfuUfaUfcUfaAfcUfaUfgAfdTsdT | 1377 | UfCfaUfaGfuUfaGfaUfaAfgAfcUfgdTsdT | 1378 |
| 608 | 608-626 | ucUfuAfuCfuAfaCfuAfuGfaUfgCfdTsdT | 1379 | GfCfaUfcAfuAfgUfuAfgAfuAfaGfadTsdT | 1380 |
| 609 | 609-627 | cuUfaUfcUfaAfcUfaUfgAfuGfcAfdTsdT | 1381 | UfGfcAfuCfaUfaGfuUfaGfaUfaAfgdTsdT | 1382 |
| 610 | 610-628 | uuAfuCfuAfaCfuAfuGfaUfgCfaAfdTsdT | 1383 | UfUfgCfaUfcAfuAfgUfuAfgAfuAfadTsdT | 1384 |
| 611 | 611-629 | uaUfcUfaAfcUfaUfgAfuGfcAfaAfdTsdT | 1385 | UfUfuGfcAfuCfaUfaGfuUfaGfaUfadTsdT | 1386 |
| 612 | 612-630 | auCfuAfaCfuAfuGfaUfgCfaAfaUfdTsdT | 1387 | AfUfuUfgCfaUfcAfuAfgUfuAfgAfudTsdT | 1388 |
| 613 | 613-631 | ucUfaAfcUfaUfgAfuGfcAfaAfuAfdTsdT | 1389 | UfAfuUfuGfcAfuCfaUfaGfuUfaGfadTsdT | 1390 |
| 614 | 614-632 | cuAfaCfuAfuGfaUfgCfaAfaUfaAfdTsdT | 1391 | UfUfaUfuUfgCfaUfcAfuAfgUfuAfgdTsdT | 1392 |
| 616 | 616-634 | aaCfuAfuGfaUfgCfaAfaUfaAfaAfdTsdT | 1393 | UfUfuUfaUfuUfgCfaUfcAfuAfgUfudTsdT | 1394 |
| 622 | 622-640 | gaUfgCfaAfaUfaAfaAfcCfgGfaCfdTsdT | 1395 | GfUfcCfgGfuUfuUfaUfuUfgCfaUfcdTsdT | 1396 |
| 623 | 623-641 | auGfcAfaAfuAfaAfaCfcGfgAfcUfdTsdT | 1397 | AfGfuCfcGfgUfuUfuAfuUfuGfcAfudTsdT | 1398 |
| 624 | 624-642 | ugCfaAfaUfaAfaAfcCfgGfaCfuGfdTsdT | 1399 | CfAfgUfcCfgGfuUfuUfaUfuUfgCfadTsdT | 1400 |
| 626 | 626-644 | caAfaUfaAfaAfcCfgGfaCfuGfaAfdTsdT | 1401 | UfUfcAfgUfcCfgGfuUfuUfaUfuUfgdTsdT | 1402 |
| 627 | 627-645 | aaAfuAfaAfaCfcGfgAfcUfgAfaGfdTsdT | 1403 | CfUfuCfaGfuCfcGfgUfuUfuAfuUfudTsdT | 1404 |
| 628 | 628-646 | aaUfaAfaAfcCfgGfaCfuGfaAfgGfdTsdT | 1405 | CfCfuUfcAfgUfcCfgGfuUfuUfaUfudTsdT | 1406 |
| 630 | 630-648 | uaAfaAfcCfgGfaCfuGfaAfgGfaGfdTsdT | 1407 | CfUfcCfuUfcAfgUfcCfgGfuUfuUfadTsdT | 1408 |
| 631 | 631-649 | aaAfaCfcGfgAfcUfgAfaGfgAfgCfdTsdT | 1409 | GfCfuCfcUfuCfaGfuCfcGfgUfuUfudTsdT | 1410 |
| 632 | 632-650 | aaAfcCfgGfaCfuGfaAfgGfaGfcUfdTsdT | 1411 | AfGfcUfcCfuUfcAfgUfcCfgGfuUfudTsdT | 1412 |
| 633 | 633-651 | aaCfcGfgAfcUfgAfaGfgAfgCfuGfdTsdT | 1413 | CfAfgCfuCfcUfuCfaGfuCfcGfgUfudTsdT | 1414 |
| 644 | 644-662 | agGfaGfcUfgCfcCfaUfgAfgAfaAfdTsdT | 1415 | UfUfuCfuCfaUfgGfgCfaGfcUfcCfudTsdT | 1416 |
| 665 | 665-683 | uaCfaGfgAfaAfuCfcUfgCfaUfgGfdTsdT | 1417 | CfCfaUfgCfaGfgAfuUfuCfcUfgUfadTsdT | 1418 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 668 | 668-686 | agGfaAfaUfcCfuGfcAfuGfgCfgCfdTsdT | 1419 | GfCfgCfcAfuGfcAfgGfaUfuUfcCfudTsdT | 1420 |
| 669 | 669-687 | ggAfaAfuCfcUfgCfaUfgGfcGfcCfdTsdT | 1421 | GfGfcGfcCfaUfgCfaGfgAfuUfuCfcdTsdT | 1422 |
| 670 | 670-688 | gaAfaUfcCfuGfcAfuGfgCfgCfcGfdTsdT | 1423 | CfGfgCfgCfcAfuGfcAfgGfaUfuUfcdTsdT | 1424 |
| 671 | 671-689 | aaAfuCfcUfgCfaUfgGfcGfcCfgUfdTsdT | 1425 | AfCfgGfcGfcCfaUfgCfaGfgAfuUfudTsdT | 1426 |
| 672 | 672-690 | aaUfcCfuGfcAfuGfgCfgCfcGfuGfdTsdT | 1427 | CfAfcGfgCfgCfcAfuGfcAfgGfaUfudTsdT | 1428 |
| 674 | 674-692 | ucCfuGfcAfuGfgCfgCfcGfuGfcGfdTsdT | 1429 | CfGfcAfcGfgCfgCfcAfuGfcAfgGfadTsdT | 1430 |
| 676 | 676-694 | cuGfcAfuGfgCfgCfcGfuGfcGfgUfdTsdT | 1431 | AfCfcGfcAfcGfgCfgCfcAfuGfcAfgdTsdT | 1432 |
| 677 | 677-695 | ugCfaUfgGfcGfcCfgUfgCfgGfuUfdTsdT | 1433 | AfAfcCfgCfaCfgGfcGfcCfaUfgCfadTsdT | 1434 |
| 678 | 678-696 | gcAfuGfgCfgCfcGfuGfcGfgUfuCfdTsdT | 1435 | GfAfaCfgCfaCfgGfcGfcCfaUfgCfcdTsdT | 1436 |
| 680 | 680-698 | auGfgCfgCfcGfuGfcGfgUfuCfaGfdTsdT | 1437 | CfUfgAfaCfcGfcAfcGfgCfgCfcAfudTsdT | 1438 |
| 681 | 681-699 | ugGfcGfcCfgUfgCfgGfuUfcAfgCfdTsdT | 1439 | GfCfuGfaAfcCfgCfaCfgGfcGfcCfadTsdT | 1440 |
| 682 | 682-700 | ggCfgCfcGfuGfcGfgUfuCfaGfcAfdTsdT | 1441 | UfGfcUfgAfaCfcGfcAfcGfgCfgCfcdTsdT | 1442 |
| 683 | 683-701 | gcGfcCfgUfgCfgGfuUfcAfgCfaAfdTsdT | 1443 | UfUfgCfuGfaAfcCfgCfaCfgGfcGfcdTsdT | 1444 |
| 684 | 684-702 | cgCfcGfuGfcGfgUfuCfaGfcAfaCfdTsdT | 1445 | GfUfuGfcUfgAfaCfcGfcAfcGfgCfgdTsdT | 1446 |
| 685 | 685-703 | gcCfgUfgCfgGfuUfcAfgCfaAfcAfdTsdT | 1447 | UfGfuUfgCfuGfaAfcCfgCfaCfgGfcdTsdT | 1448 |
| 686 | 686-704 | ccGfuGfcGfgUfuCfaGfcAfaCfaAfdTsdT | 1449 | UfUfgUfuGfcUfgAfaCfcGfcAfcGfgdTsdT | 1450 |
| 688 | 688-706 | guGfcGfgUfuCfaGfcAfaCfaAfcCfdTsdT | 1451 | GfGfuUfgUfuGfcUfgAfaCfcGfcAfcdTsdT | 1452 |
| 690 | 690-708 | gcGfgUfuCfaGfcAfaCfaAfcCfcUfdTsdT | 1453 | AfGfgGfuUfgUfuGfcUfgAfaCfcGfcdTsdT | 1454 |
| 692 | 692-710 | ggUfuCfaGfcAfaCfaAfcCfcUfgCfdTsdT | 1455 | GfCfaGfgGfuUfgUfuGfcUfgAfaCfcdTsdT | 1456 |
| 698 | 698-716 | gcAfaCfaAfcCfcUfgCfcCfuGfuGfdTsdT | 1457 | CfAfcAfgGfgCfaGfgGfuUfgUfuGfcdTsdT | 1458 |
| 700 | 700-718 | aaCfaAfcCfcUfgCfcCfuGfuGfcAfdTsdT | 1459 | UfGfcAfcAfgGfgCfaGfgGfuUfgUfudTsdT | 1460 |
| 719 | 719-737 | acGfuGfgAfgAfgCfaUfcCfaGfuGfdTsdT | 1461 | CfAfcUfgGfaUfgCfuCfuCfcAfcGfudTsdT | 1462 |
| 720 | 720-738 | cgUfgGfaGfaGfcAfuCfcAfgUfgGfdTsdT | 1463 | CfCfaCfuGfgAfuGfcUfcUfcCfaCfgdTsdT | 1464 |
| 721 | 721-739 | guGfgAfgAfgCfaUfcCfaGfuGfgCfdTsdT | 1465 | GfCfcAfcUfgGfaUfgCfuCfuCfcAfcdTsdT | 1466 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 724 | 724-742 | gaGfaGfcAfuCfcAfgUfgGfcGfgGfdTsdT | 1467 | CfCfcGfcCfaCfuGfgAfuGfcUfcUfcdTsdT | 1468 |
| 725 | 725-743 | agAfgCfaUfcCfaGfuGfgCfgGfgAfdTsdT | 1469 | UfCfcCfgCfcAfcUfgGfaUfgCfuCfudTsdT | 1470 |
| 726 | 726-744 | gaGfcAfuCfcAfgUfgGfcGfgGfaCfdTsdT | 1471 | GfUfcCfcGfcCfaCfuGfgAfuGfcUfcdTsdT | 1472 |
| 733 | 733-751 | caGfuGfgCfgGfgAfcAfuAfgUfcAfdTsdT | 1473 | UfGfaCfuAfuGfuCfcCfgCfcAfcUfgdTsdT | 1474 |
| 734 | 734-752 | agUfgGfcGfgGfaCfaUfaGfuCfaGfdTsdT | 1475 | CfUfgAfcUfaUfgUfcCfcGfcCfaCfudTsdT | 1476 |
| 736 | 736-754 | ugGfcGfgGfaCfaUfaGfuCfaGfcAfdTsdT | 1477 | UfGfcUfgAfcUfaUfgUfcCfcGfcCfadTsdT | 1478 |
| 737 | 737-755 | ggCfgGfgAfcAfuAfgUfcAfgCfaGfdTsdT | 1479 | CfUfgCfuGfaCfuAfuGfuCfcCfgCfcdTsdT | 1480 |
| 763 | 763-781 | cuCfaGfcAfaCfaUfgUfcGfaUfgGfdTsdT | 1481 | CfCfaUfcGfaCfaUfgUfuGfcUfgAfgdTsdT | 1482 |
| 765 | 765-783 | caGfcAfaCfaUfgUfcGfaUfgGfaCfdTsdT | 1483 | GfUfcCfaUfcGfaCfaUfgUfuGfcUfgdTsdT | 1484 |
| 766 | 766-784 | agCfaAfcAfuGfuCfgAfuGfgAfcUfdTsdT | 1485 | AfGfuCfcAfuCfgAfcAfuGfuUfgCfudTsdT | 1486 |
| 767 | 767-785 | gcAfaCfaUfgUfcGfaUfgGfaCfuUfdTsdT | 1487 | AfAfgUfcCfaUfcGfaCfaUfgUfuGfcdTsdT | 1488 |
| 769 | 769-787 | aaCfaUfgUfcGfaUfgGfaCfuUfcCfdTsdT | 1489 | GfGfaAfgUfcCfaUfcGfaCfaUfgUfudTsdT | 1490 |
| 770 | 770-788 | acAfuGfuCfgAfuGfgAfcUfuCfcAfdTsdT | 1491 | UfGfgAfaGfuCfcAfuCfgAfcAfuGfudTsdT | 1492 |
| 771 | 771-789 | caUfgUfcGfaUfgGfaCfuUfcCfaGfdTsdT | 1493 | CfUfgGfaAfgUfcCfaUfcGfaCfaUfgdTsdT | 1494 |
| 772 | 772-790 | auGfuCfgAfuGfgAfcUfuCfcAfgAfdTsdT | 1495 | UfCfuGfgAfaGfuCfcAfuCfgAfcAfudTsdT | 1496 |
| 775 | 775-793 | ucGfaUfgGfaCfuUfcCfaGfaAfcCfdTsdT | 1497 | GfGfuUfcUfgGfaAfgUfcCfaUfcGfadTsdT | 1498 |
| 789 | 789-807 | gaAfcCfaCfcUfgGfgCfaGfcUfgCfdTsdT | 1499 | GfCfaGfcUfgCfcCfaGfgUfgGfuUfcdTsdT | 1500 |
| 798 | 798-816 | ggGfcAfgCfuGfcCfaAfaAfgUfgUfdTsdT | 1501 | AfCfaCfuUfuUfgGfcAfgCfuGfcCfcdTsdT | 1502 |
| 800 | 800-818 | gcAfgCfuGfcCfaAfaAfgUfgUfgAfdTsdT | 1503 | UfCfaCfaCfuUfuUfgGfcAfgCfuGfcdTsdT | 1504 |
| 805 | 805-823 | ugCfcAfaAfaGfuGfuGfaUfcCfaAfdTsdT | 1505 | UfUfgGfaUfcAfcAfcUfuUfuGfgCfadTsdT | 1506 |
| 806 | 806-824 | gcCfaAfaAfgUfgUfgAfuCfcAfaGfdTsdT | 1507 | CfUfuGfgAfuCfaCfaCfuUfuUfgGfcdTsdT | 1508 |
| 807 | 807-825 | ccAfaAfaGfuGfuGfaUfcCfaAfgCfdTsdT | 1509 | GfCfuUfgGfaUfcAfcAfcUfuUfuGfgdTsdT | 1510 |
| 810 | 810-828 | aaAfgUfgUfgAfuCfcAfaGfcUfgUfdTsdT | 1511 | AfCfaGfcUfuGfgAfuCfaCfaCfuUfudTsdT | 1512 |
| 814 | 814-832 | ugUfgAfuCfcAfaGfcUfgUfcCfcAfdTsdT | 1513 | UfGfgGfaCfaGfcUfuGfgAfuCfaCfadTsdT | 1514 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 815 | 815-833 | guGfaUfcCfaAfgCfuGfuCfcCfaAfdTsdT | 1515 | UfUfgGfgAfcAfgCfuUfgGfaUfcAfcdTsdT | 1516 |
| 817 | 817-835 | gaUfcCfaAfgCfuGfuCfcCfaAfuGfdTsdT | 1517 | CfAfuUfgGfgAfcAfgCfuUfgGfaUfcdTsdT | 1518 |
| 818 | 818-836 | auCfcAfaGfcUfgUfcCfcAfaUfgGfdTsdT | 1519 | CfCfaUfuGfgGfaCfaGfcUfgfgAfudTsdT | 1520 |
| 819 | 819-837 | ucCfaAfgCfuGfuCfcCfaAfuGfgGfdTsdT | 1521 | CfCfcAfuUfgGfgAfcAfgCfuUfgGfadTsdT | 1522 |
| 820 | 820-838 | ccAfaGfcUfgUfcCfcAfaUfgGfgAfdTsdT | 1523 | UfCfcCfaUfuGfgGfaCfaGfcUfuGfgdTsdT | 1524 |
| 821 | 821-839 | caAfgCfuGfuCfcCfaAfuGfgGfaGfdTsdT | 1525 | CfUfcCfcAfuUfgGfgAfcAfgCfuUfgdTsdT | 1526 |
| 823 | 823-841 | agCfuGfuCfcCfaAfuGfgGfaGfcUfdTsdT | 1527 | AfGfcUfcCfcAfuUfgGfgAfcAfgCfudTsdT | 1528 |
| 826 | 826-844 | ugUfcCfcAfaUfgGfgAfgCfuGfcUfdTsdT | 1529 | AfGfcAfgCfuCfcCfaAfuUfgGfgAfcfadTsdT | 1530 |
| 847 | 847-865 | ggUfgCfaGfgAfgAfgGfaGfaAfcUfdTsdT | 1531 | AfGfuUfcUfcCfuCfuCfcUfgCfaCfcdTsdT | 1532 |
| 871 | 871-889 | aaAfcUfgAfcCfaAfaAfuCfaUfcUfdTsdT | 1533 | AfGfaUfgAfuUfuUfgGfuCfaGfuUfudTsdT | 1534 |
| 872 | 872-890 | aaCfuGfaCfcAfaAfaUfcAfuCfuGfdTsdT | 1535 | CfAfgAfuGfaUfuUfuGfgUfcAfgUfudTsdT | 1536 |
| 873 | 873-891 | acUfgAfcCfaAfaAfuCfaUfcUfgUfdTsdT | 1537 | AfCfaGfaUfgAfuUfuUfgGfuCfaGfudTsdT | 1538 |
| 877 | 877-895 | acCfaAfaAfuCfaUfcUfgUfgCfcCfdTsdT | 1539 | GfGfgCfaCfaGfaUfgAfuUfuUfgGfudTsdT | 1540 |
| 878 | 878-896 | ccAfaAfaUfcAfuCfuGfuGfcCfcAfdTsdT | 1541 | UfGfgGfcAfcAfgAfuGfaUfuUfuGfdTsdT | 1542 |
| 881 | 881-899 | aaAfuCfaUfcUfgUfgCfcCfaGfcAfdTsdT | 1543 | UfGfcUfgGfgCfaCfaGfaUfgAfuUfudTsdT | 1544 |
| 890 | 890-908 | guGfcCfcAfgCfaGfuGfcUfcCfgGfdTsdT | 1545 | CfCfgGfaGfcAfcUfgCfuGfgGfcAfcdTsdT | 1546 |
| 892 | 892-910 | gcCfcAfgCfaGfuGfcUfcCfgGfgCfdTsdT | 1547 | GfCfcCfgGfaGfcAfcUfgCfuGfgGfcdTsdT | 1548 |
| 929 | 929-947 | ccAfgUfgAfcUfgCfuGfcCfaCfaAfdTsdT | 1549 | UfUfgUfgGfcAfgCfaGfuCfaCfuGfgdTsdT | 1550 |
| 930 | 930-948 | caGfuGfaCfuGfcUfgCfcAfcAfaCfdTsdT | 1551 | GfUfuGfuGfgCfaGfcAfgUfcAfcUfgdTsdT | 1552 |
| 979 | 979-997 | gaGfaGfcGfaCfuGfcCfuGfgUfcUfdTsdT | 1553 | AfGfaCfcAfgGfcAfgUfcGfcUfcUfcdTsdT | 1554 |
| 980 | 980-998 | agAfgCfgAfcUfgCfcUfgGfuCfuGfdTsdT | 1555 | CfAfgAfcCfaGfgCfaGfuCfgCfuCfudTsdT | 1556 |
| 981 | 981-999 | gaGfcGfaCfuGfcCfuGfgUfcUfgCfdTsdT | 1557 | GfCfaGfaCfcAfgGfcAfgUfcGfcUfcdTsdT | 1558 |
| 982 | 982-1000 | agCfgAfcUfgCfcUfgGfuCfuGfcCfdTsdT | 1559 | GfGfcAfgAfcCfaGfgCfaGfuCfgCfudTsdT | 1560 |
| 983 | 983-1001 | gcGfaCfuGfcCfuGfgUfcUfgCfcUfdTsdT | 1561 | CfGfgCfaGfaCfcAfgGfcAfgUfcGfcdTsdT | 1562 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 984 | 984-1002 | cgAfcUfgCfcUfgGfuCfuGfcCfgCfdTsdT | 1563 | GfCfgGfcAfgAfcCfaGfgCfaGfuCfgdTsdT | 1564 |
| 989 | 989-1007 | gcCfuGfgUfcUfgCfcGfcAfaAfuUfdTsdT | 1565 | AfAfuUfuGfcGfgCfaGfaCfcAfgGfcdTsdT | 1566 |
| 990 | 990-1008 | ccUfgGfuCfuGfcCfgCfaAfaUfuCfdTsdT | 1567 | GfAfaUfuUfgCfgGfcAfgAfcCfaGfgdTsdT | 1568 |
| 991 | 991-1009 | cuGfgUfcUfgCfcGfcAfaAfuUfcCfdTsdT | 1569 | GfGfaAfuUfuGfcGfgCfaGfaCfcAfgdTsdT | 1570 |
| 992 | 992-1010 | ugGfuCfuGfcCfgCfaAfaUfuCfcGfdTsdT | 1571 | CfGfgAfaUfuUfgCfgGfcAfgAfcCfadTsdT | 1572 |
| 994 | 994-1012 | guCfuGfcCfgCfaAfaUfuCfcGfaGfdTsdT | 1573 | CfUfcGfgAfaUfuUfgCfgGfcAfgAfcdTsdT | 1574 |
| 995 | 995-1013 | ucUfgCfcGfcAfaAfuUfcCfgAfgAfdTsdT | 1575 | UfCfuCfgGfaAfuUfuGfcGfgCfaGfadTsdT | 1576 |
| 996 | 996-1014 | cuGfcCfgCfaAfaUfuCfcGfaGfaCfdTsdT | 1577 | GfUfcUfcGfgAfaUfuUfgCfgGfcAfgdTsdT | 1578 |
| 997 | 997-1015 | ugCfcGfcAfaAfuUfcCfgAfgAfcGfdTsdT | 1579 | CfGfuCfuCfgGfaAfuUfuGfcGfgCfadTsdT | 1580 |
| 999 | 999-1017 | ccGfcAfaAfuUfcCfgAfgAfcGfaAfdTsdT | 1581 | UfUfcGfuCfuCfgGfaAfuUfuGfcGfgdTsdT | 1582 |
| 1004 | 1004-1022 | aaUfuCfcGfaGfaCfgAfaGfcCfaCfdTsdT | 1583 | GfUfgGfcUfuCfgUfcUfcGfgAfaUfudTsdT | 1584 |
| 1005 | 1005-1023 | auUfcCfgAfgAfcGfaAfgCfcAfcGfdTsdT | 1585 | CfGfuGfgCfuUfcGfuCfuCfgGfaAfudTsdT | 1586 |
| 1006 | 1006-1024 | uuCfcGfaGfaCfgAfaGfcCfaCfgUfdTsdT | 1587 | AfCfgUfgGfcUfuCfgUfcUfcGfgAfadTsdT | 1588 |
| 1007 | 1007-1025 | ucCfgAfgAfcGfaAfgCfcAfcGfuGfdTsdT | 1589 | CfAfcGfuGfgCfuUfcGfuCfuCfgGfadTsdT | 1590 |
| 1008 | 1008-1026 | ccGfaGfaCfgAfaGfcCfaCfgUfgCfdTsdT | 1591 | GfCfaCfgUfgGfcUfuCfgUfcUfcGfgdTsdT | 1592 |
| 1010 | 1010-1028 | gaGfaCfgAfaGfcCfaCfgUfgCfaAfdTsdT | 1593 | UfUfgCfaCfgUfgGfcUfuCfgUfcUfcdTsdT | 1594 |
| 1013 | 1013-1031 | acGfaAfgCfcAfcGfuGfcAfaGfgAfdTsdT | 1595 | UfCfcUfuGfcAfcGfuGfgCfuUfcGfudTsdT | 1596 |
| 1014 | 1014-1032 | cgAfaGfcCfaCfgUfgCfaAfgGfaCfdTsdT | 1597 | GfUfcCfuUfgCfaCfgUfgGfcUfuCfgdTsdT | 1598 |
| 1015 | 1015-1033 | gaAfgCfcAfcGfuGfcAfaGfgAfcAfdTsdT | 1599 | UfGfuCfcUfuGfcAfcGfuGfgCfuUfcdTsdT | 1600 |
| 1016 | 1016-1034 | aaGfcCfaCfgUfgCfaAfgGfaCfaCfdTsdT | 1601 | GfUfgUfcCfuUfgCfaCfgUfgGfcUfudTsdT | 1602 |
| 1040 | 1040-1058 | ccCfcAfcUfcAfuGfcUfcUfaCfaAfdTsdT | 1603 | UfUfgUfaGfaGfcAfuGfaGfuGfgGfgdTsdT | 1604 |
| 1042 | 1042-1060 | ccAfcUfcAfuGfcUfcUfaCfaAfcCfdTsdT | 1605 | GfGfuUfgUfaGfaGfcAfuGfaGfuGfgdTsdT | 1606 |
| 1044 | 1044-1062 | acUfcAfuGfcUfcUfaCfaAfcCfcCfdTsdT | 1607 | GfGfgGfuUfgUfaGfaGfcAfuGfaGfudTsdT | 1608 |
| 1047 | 1047-1065 | caUfgCfuCfuAfcAfaCfcCfcAfcCfdTsdT | 1609 | GfGfuGfgGfgUfuGfuAfgAfgCfaUfgdTsdT | 1610 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 1071 | 1071-1089 | ccAfgAfuGfgAfuGfuGfaAfcCfcCfdTsdT | 1611 | GfGfgGfuUfcAfcAfuCfcAfuCfuGfgdTsdT | 1612 |
| 1073 | 1073-1091 | agAfuGfgAfuGfuGfaAfcCfcCfgAfdTsdT | 1613 | UfCfgGfgGfuUfcAfcAfuCfcAfuCfudTsdT | 1614 |
| 1074 | 1074-1092 | gaUfgGfaUfgUfgAfaCfcCfcGfaGfdTsdT | 1615 | CfUfcGfgGfuUfcAfcAfaUfcCfaUfcdTsdT | 1616 |
| 1075 | 1075-1093 | auGfgAfuGfuGfaAfcCfcCfgAfgGfdTsdT | 1617 | CfCfuCfgGfgGfuUfcAfcAfuCfcAfudTsdT | 1618 |
| 1077 | 1077-1095 | ggAfuGfuGfaAfcCfcCfgAfgGfgCfdTsdT | 1619 | GfCfcCfuCfgGfgGfuUfcAfcAfuCfcdTsdT | 1620 |
| 1078 | 1078-1096 | gaUfgUfgAfaCfcCfcGfaGfgGfcAfdTsdT | 1621 | UfGfcCfcUfcGfgGfgGfuUfcAfcAfuCfdTsdT | 1622 |
| 1080 | 1080-1098 | ugUfgAfaCfcCfcGfaGfgGfcAfaAfdTsdT | 1623 | UfUfuGfcCfcUfcGfgGfgGfuUfcAfcdTsdT | 1624 |
| 1084 | 1084-1102 | aaCfcCfcGfaGfgGfcAfaAfuAfcAfdTsdT | 1625 | UfGfuAfuUfuGfcCfcUfcGfgGfgUfudTsdT | 1626 |
| 1085 | 1085-1103 | acCfcCfgAfgGfgCfaAfaUfaCfaGfdTsdT | 1627 | CfUfgUfaUfuUfgCfcCfuCfgGfgGfudTsdT | 1628 |
| 1087 | 1087-1105 | ccCfgAfgGfgCfaAfaUfaCfaGfcUfdTsdT | 1629 | AfGfcUfgUfaUfuUfgCfcCfuCfgGfgdTsdT | 1630 |
| 1088 | 1088-1106 | ccGfaGfgGfcAfaAfuAfcAfgCfuUfdTsdT | 1631 | AfAfgCfuGfuAfuUfuGfcCfcUfcGfgdTsdT | 1632 |
| 1089 | 1089-1107 | cgAfgGfgCfaAfaUfaCfaGfcUfuUfdTsdT | 1633 | AfAfaGfcUfgUfaUfuUfgCfcCfuCfgdTsdT | 1634 |
| 1096 | 1096-1114 | aaAfuAfcAfgCfuUfuGfgUfgCfcAfdTsdT | 1635 | UfGfgCfaCfcAfaAfgCfuGfuAfuUfudTsdT | 1636 |
| 1097 | 1097-1115 | aaUfaCfaGfcUfuUfgGfuGfcCfaCfdTsdT | 1637 | GfUfgGfcAfcCfaAfaGfcUfgUfaUfudTsdT | 1638 |
| 1098 | 1098-1116 | auAfcAfgCfuUfuGfgUfgCfcAfcCfdTsdT | 1639 | GfGfuGfgCfaCfcAfaAfgCfuGfuAfudTsdT | 1640 |
| 1104 | 1104-1122 | cuUfuGfgUfgCfcAfcCfuGfcGfuGfdTsdT | 1641 | CfAfcGfcAfgGfuGfgCfaCfcAfaAfgdTsdT | 1642 |
| 1106 | 1106-1124 | uuGfgUfgCfcAfcCfuGfcGfuGfaAfdTsdT | 1643 | UfUfcAfcGfcAfgGfuGfgCfaCfcAfadTsdT | 1644 |
| 1112 | 1112-1130 | ccAfcCfuGfcGfuGfaAfgAfaGfuGfdTsdT | 1645 | CfAfcUfuCfuUfcAfcGfcAfgGfuGfgdTsdT | 1646 |
| 1116 | 1116-1134 | cuGfcGfuGfaAfgAfaGfuGfuCfcCfdTsdT | 1647 | GfGfgAfcAfcUfuCfuUfcAfcGfcAfgdTsdT | 1648 |
| 1117 | 1117-1135 | ugCfgUfgAfaGfaAfgUfgUfcCfcCfdTsdT | 1649 | GfGfgGfaCfaCfuUfcUfuCfaCfgCfadTsdT | 1650 |
| 1118 | 1118-1136 | gcGfuGfaAfgAfaGfuGfuCfcCfcGfdTsdT | 1651 | CfGfgGfgAfcAfcUfuCfuUfcAfcGfcdTsdT | 1652 |
| 1119 | 1119-1137 | cgUfgAfaGfaAfgUfgUfcCfcCfgUfdTsdT | 1653 | AfCfgGfgGfaCfaCfuUfcUfuCfaCfgdTsdT | 1654 |
| 1120 | 1120-1138 | guGfaAfgAfaGfuGfuCfcCfcGfuAfdTsdT | 1655 | UfAfcGfgGfgAfcAfcUfuCfuUfcAfcdTsdT | 1656 |
| 1121 | 1121-1139 | ugAfaGfaAfgUfgUfcCfcCfgUfaAfdTsdT | 1657 | UfUfaCfgGfgGfaCfaCfuUfcUfuCfadTsdT | 1658 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1122 | 1122-1140 | gaAfgAfaGfuGfuCfcCfcGfuAfaUfdTsdT | 1659 | AfUfuAfcGfgGfgAfcAfcUfuCfuUfcdTsdT | 1660 |
| 1123 | 1123-1141 | aaGfaAfgUfgUfcCfcCfgUfaAfuUfdTsdT | 1661 | AfAfuUfaCfgGfgGfaCfaCfuUfcUfudTsdT | 1662 |
| 1124 | 1124-1142 | agAfaGfuGfuCfcCfcGfuAfaUfuAfdTsdT | 1663 | UfAfaUfuAfcGfgGfgAfcAfcUfuCfudTsdT | 1664 |
| 1125 | 1125-1143 | gaAfgUfgUfcCfcCfgUfaAfuUfaUfdTsdT | 1665 | AfUfaAfuUfaCfgGfgGfaCfaCfuUfcdTsdT | 1666 |
| 1126 | 1126-1144 | aaGfuGfuCfcCfcGfuAfaUfuAfuGfdTsdT | 1667 | CfAfuAfaUfuAfcGfgGfgAfcAfcUfudTsdT | 1668 |
| 1127 | 1127-1145 | agUfgUfcCfcCfgUfaAfuUfaUfgUfdTsdT | 1669 | AfCfaUfaAfuUfaCfgGfgGfaCfaCfudTsdT | 1670 |
| 1128 | 1128-1146 | guGfuCfcCfcGfuAfaUfuAfuGfuGfdTsdT | 1671 | CfAfcAfuAfaUfuAfcGfgGfgAfcAfcdTsdT | 1672 |
| 1129 | 1129-1147 | ugUfcCfcCfgUfaAfuUfaUfgUfgGfdTsdT | 1673 | CfCfaCfaUfaAfuUfaCfgGfgGfaCfadTsdT | 1674 |
| 1130 | 1130-1148 | guCfcCfcGfuAfaUfuAfuGfuGfgGfdTsdT | 1675 | AfCfcAfcAfuAfaUfuAfcGfgGfgAfcdTsdT | 1676 |
| 1132 | 1132-1150 | ccCfcGfuAfaUfuAfuGfuGfgUfgAfdTsdT | 1677 | UfCfaCfcAfcAfuAfaUfuAfcGfgGfgdTsdT | 1678 |
| 1134 | 1134-1152 | ccGfuAfaUfuAfuGfuGfgUfgAfcAfdTsdT | 1679 | UfGfuCfaCfcAfcAfuAfaUfuAfcGfgdTsdT | 1680 |
| 1136 | 1136-1154 | guAfaUfuAfuGfuGfgUfgAfcAfgAfdTsdT | 1681 | UfCfuGfuCfaCfcAfcAfuAfaUfuAfcdTsdT | 1682 |
| 1137 | 1137-1155 | uaAfuUfaUfgUfgGfuGfaCfaGfaUfdTsdT | 1683 | AfUfcUfgUfcAfcCfaCfaUfaAfuUfadTsdT | 1684 |
| 1138 | 1138-1156 | aaUfuAfuGfuGfgUfgAfcAfgAfuCfdTsdT | 1685 | GfAfuCfuGfuCfaCfcAfcAfuAfaUfudTsdT | 1686 |
| 1139 | 1139-1157 | auUfaUfgUfgGfuGfaCfaGfaUfcAfdTsdT | 1687 | UfGfaUfcUfgUfcAfcCfaCfaUfaAfudTsdT | 1688 |
| 1140 | 1140-1158 | uuAfuGfuGfgUfgAfcAfgAfuCfuAfdTsdT | 1689 | GfUfgAfuCfuGfuCfaCfcAfcAfuAfadTsdT | 1690 |
| 1142 | 1142-1160 | auGfuGfgUfgAfcAfgAfuCfuAfcGfdTsdT | 1691 | CfCfgUfgAfuCfuGfuCfaCfcAfcAfudTsdT | 1692 |
| 1145 | 1145-1163 | ugGfuGfaCfaGfaUfcAfcGfgCfuCfdTsdT | 1693 | GfAfgCfcGfuGfaUfcUfgUfcAfccCfadTsdT | 1694 |
| 1147 | 1147-1165 | guGfaCfaGfaUfcAfcGfgCfuCfgUfdTsdT | 1695 | AfCfgAfgCfcGfuGfaUfcUfgUfcAfcdTsdT | 1696 |
| 1148 | 1148-1166 | ugAfcAfgAfuCfaCfgGfcUfcGfuGfdTsdT | 1697 | CfAfcGfaGfcCfgUfgAfuCfuGfuCfadTsdT | 1698 |
| 1149 | 1149-1167 | gaCfaGfaUfcAfcGfgCfuCfgUfgCfdTsdT | 1699 | GfCfaCfgAfgCfcGfuGfaUfcUfgUfcdTsdT | 1700 |
| 1150 | 1150-1168 | acAfgAfuCfaCfgGfcUfcGfuGfcGfdTsdT | 1701 | CfGfcAfcGfaGfcCfgUfgAfuCfuGfudTsdT | 1702 |
| 1151 | 1151-1169 | caGfaUfcAfcGfgCfuCfgUfgCfgUfdTsdT | 1703 | AfCfgCfaCfgAfgCfcGfuGfaUfcUfgdTsdT | 1704 |
| 1152 | 1152-1170 | agAfuCfaCfgGfcUfcGfuGfcGfuCfdTsdT | 1705 | GfAfcGfcAfcGfaGfcCfgUfgAfuCfudTsdT | 1706 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1153 | 1153-1171 | gaUfcAfcGfgCfuCfgUfgCfgUfcCfdTsdT | 1707 | GfGfaCfgCfaCfgAfgCfcGfuGfaUfcdTsdT | 1708 |
| 1154 | 1154-1172 | auCfaCfgGfcUfcGfuGfcGfuCfcGfdTsdT | 1709 | CfGfgAfcGfcAfcGfaGfcCfgUfgAfudTsdT | 1710 |
| 1155 | 1155-1173 | ucAfcGfgCfuCfgUfgCfgUfcCfgAfdTsdT | 1711 | UfCfgGfaCfgCfaCfgAfgCfcGfuGfadTsdT | 1712 |
| 1156 | 1156-1174 | caCfgGfcUfcGfuGfcGfuCfcGfaGfdTsdT | 1713 | CfUfcGfgAfcGfcAfcGfaGfcCfgUfgdTsdT | 1714 |
| 1157 | 1157-1175 | acGfgCfuCfgUfgCfgUfcCfgAfgCfdTsdT | 1715 | GfCfuCfgGfaCfgCfaCfgAfgCfcGfudTsdT | 1716 |
| 1160 | 1160-1178 | gcUfcGfuGfcGfuCfcGfaGfcCfuGfdTsdT | 1717 | CfAfgGfcUfcGfgAfcGfcAfcGfaGfcdTsdT | 1718 |
| 1200 | 1200-1218 | ggAfgGfaAfgAfcGfgCfgUfcCfgCfdTsdT | 1719 | GfCfgGfaCfgCfcGfuCfuUfcCfuCfcdTsdT | 1720 |
| 1201 | 1201-1219 | gaGfgAfaGfaCfgGfcGfuCfcGfcAfdTsdT | 1721 | UfGfcGfgAfcGfcCfgUfcUfuCfcUfcdTsdT | 1722 |
| 1203 | 1203-1221 | ggAfaGfaCfgGfcGfuCfcGfcAfaGfdTsdT | 1723 | CfUfuGfcGfgAfcGfcCfgUfcUfuCfcdTsdT | 1724 |
| 1204 | 1204-1222 | gaAfgAfcGfgCfgUfcCfgCfaAfgUfdTsdT | 1725 | AfCfuUfgCfgGfaCfgCfcGfuCfuUfcdTsdT | 1726 |
| 1205 | 1205-1223 | aaGfaCfgGfcGfuCfcGfcAfaGfuGfdTsdT | 1727 | CfAfcUfuGfcGfgAfcGfcCfgUfcUfudTsdT | 1728 |
| 1207 | 1207-1225 | gaCfgGfcGfuCfcGfcAfaGfuGfuAfdTsdT | 1729 | UfAfcAfcUfuGfcGfgAfcGfcCfgUfcdTsdT | 1730 |
| 1208 | 1208-1226 | acGfgCfgUfcCfgCfaAfgUfgUfaAfdTsdT | 1731 | UfUfaCfaCfuUfgCfgGfaCfgCfcGfudTsdT | 1732 |
| 1211 | 1211-1229 | gcGfuCfcGfcAfaGfuGfuAfaGfaAfdTsdT | 1733 | UfUfcUfuAfcAfcUfuGfcGfgAfcGfcdTsdT | 1734 |
| 1212 | 1212-1230 | cgUfcCfgCfaAfgUfgUfaAfgAfaGfdTsdT | 1735 | CfUfuCfuUfaCfaCfuUfgCfgGfaCfgdTsdT | 1736 |
| 1213 | 1213-1231 | guCfcGfcAfaGfuGfuAfaGfaAfgUfdTsdT | 1737 | AfCfuUfcUfuAfcAfcUfuGfcGfgAfcdTsdT | 1738 |
| 1214 | 1214-1232 | ucCfgCfaAfgUfgUfaAfgAfaGfuGfdTsdT | 1739 | CfAfcUfuCfuUfaCfaCfuUfgCfgGfadTsdT | 1740 |
| 1215 | 1215-1233 | ccGfcAfaGfuGfuAfaGfaAfgUfgCfdTsdT | 1741 | GfCfaCfuUfcUfuAfcAfcUfuGfcGfgdTsdT | 1742 |
| 1216 | 1216-1234 | cgCfaAfgUfgUfaAfgAfaGfuGfcGfdTsdT | 1743 | CfGfcAfcUfuCfuUfaCfaCfuUfgCfgdTsdT | 1744 |
| 1217 | 1217-1235 | gcAfaGfuGfuAfaGfaAfgUfgCfgAfdTsdT | 1745 | UfCfgCfaCfuUfcUfuAfcAfcUfuGfcdTsdT | 1746 |
| 1219 | 1219-1237 | aaGfuGfuAfaGfaAfgUfgCfgAfgGfdTsdT | 1747 | CfUfcGfcAfcUfuCfuUfaCfaCfuUfgdTsdT | 1748 |
| 1220 | 1220-1238 | agUfgUfaAfgAfaGfuGfcGfaAfgGfdTsdT | 1749 | CfCfuUfcGfcAfcUfuCfuUfaCfaCfudTsdT | 1750 |
| 1221 | 1221-1239 | guGfuAfaGfaAfgUfgCfgAfaGfgGfdTsdT | 1751 | CfCfcUfuCfgCfaCfuUfcUfuAfcAfcdTsdT | 1752 |
| 1222 | 1222-1240 | ugUfaAfgAfaGfuGfcGfaAfgGfgGfdTsdT | 1753 | GfCfcCfuUfcGfcAfcUfuCfuUfaCfadTsdT | 1754 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1223 | 1223-1241 | guAfaGfaAfgUfgCfgAfaGfgGfcCfdTsdT | 1755 | GfGfcCfcUfuCfgCfaCfuUfcUfuAfcdTsdT | 1756 |
| 1224 | 1224-1242 | uaAfgAfaGfuGfcGfaAfgGfgCfcUfdTsdT | 1757 | AfGfgCfcCfuUfcGfcAfcUfcfuUfadTsdT | 1758 |
| 1225 | 1225-1243 | aaGfaAfgUfgCfgAfaGfgGfcCfuUfdTsdT | 1759 | AfAfgGfcCfcUfuCfgCfaCfuUfcUfudTsdT | 1760 |
| 1226 | 1226-1244 | agAfaGfuGfcGfaAfgGfgCfcUfuGfdTsdT | 1761 | CfAfaGfgCfcCfuUfcGfcAfcUfuCfudTsdT | 1762 |
| 1229 | 1229-1247 | agUfgCfgAfaGfgGfcCfuUfgCfcGfdTsdT | 1763 | CfGfgCfaAfgGfcCfcUfuCfgCfaCfudTsdT | 1764 |
| 1230 | 1230-1248 | guGfcGfaAfgGfgCfcUfuGfcCfgCfdTsdT | 1765 | GfCfgGfcAfaGfgCfcCfuUfcGfcAfcdTsdT | 1766 |
| 1231 | 1231-1249 | ugCfgAfaGfgGfcCfuUfgCfcGfcAfdTsdT | 1767 | UfGfcGfgCfaAfgGfcCfcUfuCfgCfadTsdT | 1768 |
| 1232 | 1232-1250 | gcGfaAfgGfgCfcUfuGfcCfgCfaAfdTsdT | 1769 | UfUfgCfgGfcAfaGfgCfcCfuUfcGfcdTsdT | 1770 |
| 1233 | 1233-1251 | cgAfaGfgGfcCfuUfgCfcGfcAfaAfdTsdT | 1771 | UfUfuGfcGfgCfaAfgGfcCfcUfuCfgdTsdT | 1772 |
| 1235 | 1235-1253 | aaGfgGfcCfuUfgCfcGfcAfaAfgUfdTsdT | 1773 | AfCfuUfuGfcGfgCfaAfgGfcCfcUfudTsdT | 1774 |
| 1236 | 1236-1254 | agGfgCfcUfuGfcCfgCfaAfaGfuGfdTsdT | 1775 | CfAfcUfuUfgCfgGfcAfaGfgCfcCfudTsdT | 1776 |
| 1237 | 1237-1255 | ggGfcCfuUfgCfcGfcAfaAfgUfgUfdTsdT | 1777 | AfCfaCfuUfuGfcGfgCfaAfgGfcCfcdTsdT | 1778 |
| 1238 | 1238-1256 | ggCfcUfuGfcCfgCfaAfaGfuGfuGfdTsdT | 1779 | CfAfcAfcUfuUfgCfgGfcAfaGfgCfcdTsdT | 1780 |
| 1239 | 1239-1257 | gcCfuUfgCfcGfcAfaAfgUfgUfgUfdTsdT | 1781 | AfCfaCfaCfuUfuGfcGfgCfaAfgGfcdTsdT | 1782 |
| 1241 | 1241-1259 | cuUfgCfcGfcAfaAfgUfgUfgUfaAfdTsdT | 1783 | UfUfaCfaCfaCfuUfuGfcGfgCfaAfgdTsdT | 1784 |
| 1261 | 1261-1279 | ggAfaUfaGfgUfaUfuGfgUfgAfaUfdTsdT | 1785 | AfUfuCfaCfcAfaUfaCfcUfaUfuCfcdTsdT | 1786 |
| 1262 | 1262-1280 | gaAfuAfgGfuAfuUfgGfuGfaAfuUfdTsdT | 1787 | AfAfuUfcAfcCfaAfuAfcCfuAfuUfcdTsdT | 1788 |
| 1263 | 1263-1281 | aaUfaGfgUfaUfuGfgUfgAfaUfuUfdTsdT | 1789 | AfAfaUfuCfaCfcAfaUfaCfcUfaUfudTsdT | 1790 |
| 1264 | 1264-1282 | auAfgGfuAfuUfgGfuGfaAfuUfuAfdTsdT | 1791 | UfAfaAfuUfcAfcCfaAfuAfcCfuAfudTsdT | 1792 |
| 1266 | 1266-1284 | agGfuAfuUfgGfuGfaAfuUfuAfaAfdTsdT | 1793 | UfUfuAfaAfuUfcAfcCfaAfuAfcCfudTsdT | 1794 |
| 1267 | 1267-1285 | ggUfaUfuGfuGfaAfuUfuAfaAfgUfdTsdT | 1795 | CfUfuUfaAfaUfcAfcCfaAfuAfcCfdTsdT | 1796 |
| 1289 | 1289-1307 | caCfuCfuCfcAfuAfaAfuGfcUfaCfdTsdT | 1797 | GfUfaGfcAfuUfuAfuGfgAfgAfgUfgdTsdT | 1798 |
| 1313 | 1313-1331 | uuAfaAfcAfcUfuCfaAfaAfcUfuGfdTsdT | 1799 | CfAfgUfuUfuGfaAfgUfgUfuUfaAfadTsdT | 1800 |
| 1320 | 1320-1338 | cuUfcAfaAfaAfcUfgCfaCfcUfcCfdTsdT | 1801 | GfGfaGfgUfgCfaGfuUfuUfuGfaAfgdTsdT | 1802 |

TABLE 3-continued

EGFR siRNA Sequences with Chemical Modifications

| hs Id # | Sequence position in NM_005228.3 (5'-3') | sense strand sequence | SEQ ID NO: | antisense strand sequence (5'-3') | SEQ ID NO: |
|---|---|---|---|---|---|
| 1321 | 1321-1339 | uuCfaAfaAfaCfuGfcAfcCfuCfcAfdTsdT | 1803 | UfGfgAfgGfuGfcAfgUfuUfuUfgAfadTsdT | 1804 |
| 1322 | 1322-1340 | ucAfaAfaAfcUfgCfaCfcUfcCfaUfdTsdT | 1805 | AfUfgGfaGfgUfgCfaGfuUfuUfuGfadTsdT | 1806 |
| 1323 | 1323-1341 | caAfaAfaCfuGfcAfcCfuCfcAfuCfdTsdT | 1807 | GfAfuGfaGfgUfgCfaGfuUfuUffgdTsdT | 1808 |
| 1324 | 1324-1342 | aaAfaAfcUfgCfaCfcUfcCfaUfcAfdTsdT | 1809 | UfGfaUfgGfaGfgUfgCfaGfuUfuUfudTsdT | 1810 |
| 1328 | 1328-1346 | acUfgCfaCfcUfcCfaUfcAfgUfgGfdTsdT | 1811 | CfCfaCfuGfaUfgGfaGfgUfgCfaGfudTsdT | 1812 |
| 1332 | 1332-1350 | caCfcUfcCfaUfcAfgUfgGfcGfaUfdTsdT | 1813 | AfUfcGfcCfaCfuGfaUfgGfaGfgUfgdTsdT | 1814 |
| 1333 | 1333-1351 | acCfuCfcAfuCfaGfuGfgCfgAfuCfdTsdT | 1815 | GfAfuCfgCfcAfcUfgAfuGfgAfgGfudTsdT | 1816 |
| 1335 | 1335-1353 | cuCfcAfuCfaGfuGfgCfgAfuCfuCfdTsdT | 1817 | GfAfgAfuCfgCfcAfcUfgAfuGfgAfgdTsdT | 1818 |
| 1338 | 1338-1356 | caUfcAfgUfgGfcGfaUfcUfcCfaCfdTsdT | 1819 | GfUfgGfaGfaUfcGfcCfaCfuGfaUfgdTsdT | 1820 |
| 1344 | 1344-1362 | ugGfcGfaUfcUfcCfaCfaUfcCfuGfdTsdT | 1821 | CfAfgGfaUfgUfgGfaGfaUfcGfcCfadTsdT | 1822 |
| 1345 | 1345-1363 | ggCfgAfuCfuCfcAfcAfuCfcUfgCfdTsdT | 1823 | GfCfaGfgAfuGfuGfgAfgAfuCfgCfcdTsdT | 1824 |
| 1346 | 1346-1364 | gcGfaUfcUfcCfaCfaUfcCfuGfcCfdTsdT | 1825 | GfGfcAfgGfaUfgUfgGfaGfaUfcGfcdTsdT | 1826 |
| 1347 | 1347-1365 | cgAfuCfuCfcAfcAfuCfcUfgCfcGfdTsdT | 1827 | CfGfgCfaGfgAfuGfuGfgAfgAfuCfgdTsdT | 1828 |
| 1348 | 1348-1366 | gaUfcUfcCfaCfaUfcCfuGfcCfgGfdTsdT | 1829 | CfCfgGfcAfgGfaUfgUfgGfaGfaUfcdTsdT | 1830 |
| 1353 | 1353-1371 | ccAfcAfuCfcUfgCfcGfgUfgGfcAfdTsdT | 1831 | UfGfcCfaCfcGfgCfaGfgAfuGfuGfgdTsdT | 1832 |
| 1354 | 1354-1372 | caCfaUfcCfuGfcCfgGfuGfgCfaUfdTsdT | 1833 | AfUfgCfcAfcCfgGfcAfgGfaUfgUfgdTsdT | 1834 |
| 1355 | 1355-1373 | acAfuCfcUfgCfcGfgUfgGfcAfuUfdTsdT | 1835 | AfAfuGfcCfaCfcGfgCfaGfgAfuGfudTsdT | 1836 |
| 1357 | 1357-1375 | auCfcUfgCfcGfgUfgGfcAfuUfuAfdTsdT | 1837 | UfAfaAfuGfcCfaCfcGfgCfaGfgAfudTsdT | 1838 |
| 1360 | 1360-1378 | cuGfcCfgGfuGfgCfaUfuUfaGfgGfdTsdT | 1839 | CfCfcUfaAfaUfgCfcAfcCfgGfcAfgdTsdT | 1840 |
| 1361 | 1361-1379 | ugCfcGfgUfgGfcAfuUfuAfgGfgGfdTsdT | 1841 | CfCfcCfuAfaAfuGfcCfaCfcGfgCfadTsdT | 1842 |
| 1362 | 1362-1380 | gcCfgGfuGfgCfaUfuUfaGfgGfgUfdTsdT | 1843 | AfCfcCfcUfaAfaUfgCfcAfcCfgGfcdTsdT | 1844 |
| 1363 | 1363-1381 | ccGfgUfgGfcAfuUfuAfgGfgGfuGfdTsdT | 1845 | CfAfcCfcCfuAfaAfuGfcCfaCfcGfgdTsdT | 1846 |
| 1366 | 1366-1384 | guGfcAfuUfuAfgGfgGfuGfaAfcUfdTsdT | 1847 | AfGfuCfaCfcCfcUfaAfaUfgCfcAfcdTsdT | 1848 |
| 1369 | 1369-1387 | gcAfuUfuAfgGfgGfuGfaCfuCfcUfdTsdT | 1849 | AfGfgAfgUfcAfcCfcCfuAfaAfuGfcdTsdT | 1850 |

TABLE 3-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1370 | 1370-1388 | caUfuUfaGfgGfgUfgAfcUfcCfuUfdTsdT | 1851 | AfAfgGfaGfuCfaCfcCfcUfaAfaUfgdTsdT | 1852 |
| 1371 | 1371-1389 | auUfuAfgGfgGfuGfaCfuCfcUfuCfdTsdT | 1853 | GfAfaGfgAfgUfcAfcCfcCfuAfaAfudTsdT | 1854 |
| 1372 | 1372-1390 | uuUfaGfgGfgUfgAfcUfcCfuUfcAfdTsdT | 1855 | UfGfaAfgGfaGfuCfaCfcCfcUfaAfadTsdT | 1856 |
| 1373 | 1373-1391 | uuAfgGfgGfuGfaCfuCfcUfuCfaCfdTsdT | 1857 | GfUfgAfaGfgAfgUfcAfcCfcCfuAfadTsdT | 1858 |
| 1374 | 1374-1392 | uaGfgGfgUfgAfcUfcCfuUfcAfcAfdTsdT | 1859 | UfGfuGfaAfgGfaGfuCfaCfcCfcUfadTsdT | 1860 |
| 1404 | 1404-1422 | ucUfgGfaUfcCfaCfaGfgAfaCfuGfdTsdT | 1861 | CfAfgUfuCfcUfgUfgGfaUfcCfaGfadTsdT | 1862 |
| 1408 | 1408-1426 | gaUfcCfaCfaGfgAfaCfuGfgAfuAfdTsdT | 1863 | UfAfuCfcAfgUfuCfcUfgUfgGfaUfcdTsdT | 1864 |
| 1409 | 1409-1427 | auCfcAfcAfgGfaAfcUfgGfaUfaUfdTsdT | 1865 | AfUfaUfcCfaGfuUfcCfuGfuGfgAfudTsdT | 1866 |
| 1411 | 1411-1429 | ccAfcAfgGfaAfcUfgGfaUfaUfcFdTsdT | 1867 | GfAfaUfaUfcCfaGfuUfcCfuGfuGfgdTsdT | 1868 |
| 1412 | 1412-1430 | caCfaGfgAfaCfuGfgAfuAfuUfcUfdTsdT | 1869 | AfGfaAfuAfuCfcAfgUfuCfcUfgUfgdTsdT | 1870 |
| 1419 | 1419-1437 | acUfgGfaUfaUfuCfuGfaAfaAfcCfdTsdT | 1871 | GfGfuUfuUfcAfgAfaUfaUfcCfaGfudTsdT | 1872 |
| 1426 | 1426-1444 | auUfcUfgAfaAfaCfcGfuAfaAfgGfdTsdT | 1873 | CfCfuUfuAfcGfgUfuUfuCfaGfaAfudTsdT | 1874 |
| 1427 | 1427-1445 | uuCfuGfaAfaAfcCfgUfaAfaGfgAfdTsdT | 1875 | UfCfcUfuUfaCfgGfuUfuUfcAfgAfadTsdT | 1876 |
| 1430 | 1430-1448 | ugAfaAfaCfcGfuAfaAfgGfaAfaUfdTsdT | 1877 | AfUfuUfcCfuUfuAfcGfgUfuUfuCfadTsdT | 1878 |
| 1431 | 1431-1449 | gaAfaAfcCfgUfaAfaGfgAfaAfuCfdTsdT | 1879 | GfAfuUfuCfcUfuUfaCfgGfuUfuUfcdTsdT | 1880 | siRNA Sequence with Chemical Modification Info
lower case (n) = 2'-O-Me;
Nf = 2'-F;
dT = deoxy-T residue;
s = phosphorothioate backbone modification;
iB = inverted abasic Example 2. Evaluation of In Vitro Potency of Anti-EGFR siRNAs Each of the anti-EGFR siRNAs in Table 4 were transfected in each of three human non-small cell lung cancer (NSCLC) cell lines with the indicated EGFR mutational status:
H358: wild-type
H1650: Exon19 ΔE746-A750 deletion
H1975: Exon21 L858R and Exon20 T790M At a single final concentration of 5 nM, each siRNA was formulated with a commercially-available transfection reagent (Lipofectamine RNAiMAX, Life Technologies) according to the manufacturer's "forward transfection" instructions. Cells were plated 24 h prior to transfection in duplicate within 24-well tissue culture plates. At 24 h (H1650 and H1975) or 48 h (H358) post-transfection, RNA was harvested from cells in all wells using a Qiagen RNeasy® Plus Mini Kit or Stratec InviTrap® RNA Cell HTS96 kit. The concentration of each isolated RNA was determined via A260 measurement using a NanoDrop spectrophotometer. RNA samples were then reverse transcribed to cDNA using the High Capacity RNA to cDNA Kit (Life Technologies) according to the manufacturer's instructions. cDNA samples were then evaluated by qPCR using EGFR-specific probes with results normalized to endogenous β-actin and quantified using the standard $2^{-\Delta\Delta Ct}$ method. EGFR mRNA levels normalized to expression in controls were determined.

TABLE 4

| Avidity ID# | sense strand sequence (5'-3') | SEQ ID NO: | antisense strand sequence (5'-3') | SEQ ID NO: | qPCR, H358, 5 nM % Rel EGFR mRNA | qPCR, H1650, 5 nM % Rel EGFR mRNA | qPCR, H1975, 5 nM % Rel EGFR mRNA |
|---|---|---|---|---|---|---|---|
| R-1006 | agUfuUfgCfcAfaGfgCfaCfgAfgUfdTsdT | 1217 | AfCfuCfgUfgCfcUfuGfgCfaAfaCfudTsdT | 1218 | 7.80% | 5.50% | 12.20% |
| R-1010 | agCfaGfuCfuUfaUfcUfaAfcUfaUfdTsdT | 1373 | AfUfaGfuUfaGfaUfaAfgAfcUfgCfudTsdT | 1374 | 3.80% | 3.50% | 8.60% |
| R-1018 | gcCfgUfgCfgGfuUfcAfgCfaAfcAfdTsdT | 1447 | UfGfuUfgCfuGfaAfcCfgCfaCfgGfcdTsdT | 1448 | 7.40% | 6.50% | 13.00% |
| R-1011 | gaUfgCfaAfaUfaAfaAfcCfgGfaCfdTsdT | 1395 | GfUfcCfgGfuUfuUfaUfuUfgCfaUfcdTsdT | 1396 | 9.70% | 4.80% | 10.10% |
| R-1001 | gaCfgAfcAfgGfcCfaCfcUfcGfuCfdTsdT | 1147 | GfAfcGfaGfgUfgGfcCfuGfucCfgUfcdTsdT | 1148 | 95.40% | 118.90% | 109.30% |
| R-1002 | acGfaCfaGfgCfcAfcCfuCfgUfcGfdTsdT | 1149 | CfGfaCfgAfgGfuGfgCfcUfgUfcGfudTsdT | 1150 | 69.30% | 98.10% | 112.20% |
| R-1003 | ccAfcCfuCfgUfcGfgCfgUfcCfgCfdTsdT | 1163 | GfCfgGfaCfgCfcGfaCfgAfgGfuGfgdTsdT | 1164 | 59.10% | 81.50% | 92.40% |
| R-1004 | guCfgGfcGfuCfcGfcCfcGfaGfuCfdTsdT | 1177 | GfAfcUfcGfgGfcGfgAfcGfcCfgAfcdTsdT | 1178 | 93.40% | 121.30% | 123.40% |
| R-1005 | ccAfcAfaCfcAfcCfgCfgCfaCfgGfdTsdT | 1193 | CfCfgUfgCfgCfgGfuGfgUfuGfuGfgdTsdT | 1194 | 70.30% | 90.80% | 124.10% |
| R-1007 | uuUfgCfcAfaGfgCffaCfgAfgUfaAfdTsdT | 1221 | UfUfaCfuCfgUfgCfcUfuGfcfaAfadTsdT | 1222 | 73.40% | 75.70% | 107.10% |
| R-1008 | auGfcCfuUfaGfcAfgUfcUfuAfcCfdTsdT | 1359 | GfAfuAfaGfaCfuGfcUfaAfgGfcAfudTsdT | 1360 | 8.50% | 7.70% | 30.60% |
| R-1009 | uuAfgCfaGfuCfuUffaUfcUfaAfcUfdTsdT | 1369 | AfGfuUfaGfaUfaAfgAfcUfgCfuAfadTsdT | 1370 | 10.50% | 10.60% | 25.70% |
| R-1012 | auGfcAfaAfuAfaAffaCfcGfgAfcUfdTsdT | 1397 | AfGfuCfcGfgUfuUfUfaAfuUfuGfcAfudTsdT | 1398 | 22.30% | 20.40% | 41.30% |
| R-1013 | ugCfaAfaUfaAfaAfcCfgGfaCfuGfdTsdT | 1399 | CfAfgUfcCfgGfuUfuUfaUfuUfgCfadTsdT | 1400 | 22.80% | 24.80% | 50.00% |
| R-1014 | agGfaAfaUfcCfuGfcAfuUfgGfcGfdTsdT | 1419 | GfCfgCfcAfuUfgCfaAfgGfaUfuUfcCfudTsdT | 1420 | 17.50% | 12.10% | 24.30% |
| R-1015 | ggAfaAfuCfcUfgCfaUfgGfcGfcCfdTsdT | 1421 | GfGfcGfcCfaUfgCfaGfgAfuUfuCfcdTsdT | 1422 | 41.30% | 41.10% | 66.00% |
| R-1016 | aaAfuCfcUfgCfaUfggGfcGfcCfgUfdTsdT | 1425 | AfCfgGfcGfcCfaUfgCfaGfgAfuUfudTsdT | 1426 | 89.90% | 89.70% | 94.40% |
| R-1017 | ugCfaUfgGfcGfcCfgUfgCfgGfuUfdTsdT | 1433 | AfAfcCfgCfaCfgGfcGfcCfaUfgCfadTsdT | 1434 | 81.40% | 99.20% | 108.60% |
| R-1019 | gcGfgUfuUfcAfgGfcAfaCfaCffcUfdTsdT | 1453 | AfGfgUfgUfuGfuUfgCfUfgAfaCfcGfcdTsdT | 1454 | 30.20% | 24.70% | 45.10% |
| R-1020 | agUfgGfcGfgGfaCffaUfaGfuCfaGfdTsdT | 1475 | CfUfgAfcUfaUfgUfcCfCfcGfcCfaCfudTsdT | 1476 | 71.80% | 60.50% | 82.50% |

TABLE 4-continued

| Avidity ID# | sense strand sequence (5'-3') | SEQ ID NO: | antisense strand sequence (5'-3') | SEQ ID NO: | qPCR, H358, 5 nM % Rel EGFR mRNA | qPCR, H1650, 5 nM % Rel EGFR mRNA | qPCR, H1975, 5 nM % Rel EGFR mRNA |
| --- | --- | --- | --- | --- | --- | --- | --- |
| R-1021 | cuCfaGfcAfaCfaUf gUfcGfaUfgGfdTsdT | 1481 | CfCfaUfcGfaCfaUfg UfuGfcUfgAfgdTsdT | 1482 | 61.70% | 99.40% | 91.10% |
| R-1022 | gaUfcCfaAfgCfuGf uCfcCfaAfuGfdTsdT | 1517 | CfAfuUfgGfgAfcAfg CfuUfgGfaUfcdTsdT | 1518 | 26.40% | 24.50% | 58.60% |
| R-1023 | ccAfaGfcUfgUfcCf cAfaUfgGfgAfdTsdT | 1523 | UfCfcCfaUfuGfgGfa CfaGfcUfuGfgdTsdT | 1524 | 61.30% | 84.80% | 99.00% |
| R-1024 | gcCfuGfgUfcUfgC fcGfcAfaAfuUfdTsdT | 1565 | AfAfuUfuGfcGfgCfa GfaCfcAfgGfcdTsdT | 1566 | 20.00% | 15.30% | 23.60% |
| R-1025 | ccUfgGfuCfuGfcCf gCfaAfaUfuCfdTsdT | 1567 | GfAfaUfuUfgCfgGfc AfgAfcCfaGfgdTsdT | 1568 | 81.40% | 77.40% | 95.00% |
| R-1026 | cuGfgUfcUfgCfcG fcAfaAfuUfcCfdTsdT | 1569 | GfGfaAfuUfuGfcGfg CfaGfaCfcAfgdTsdT | 1570 | 20.40% | 24.20% | 65.90% |
| R-1027 | ugGfuCfuGfcCfgC faAfaUfuCfcGfdTsdT | 1571 | CfGfgAfaUfuUfgCfg GfcAfgAfcCfadTsdT | 1572 | 15.40% | 11.30% | 41.20% |
| R-1028 | cuGfcCfgCfaAfaUf uCfcGfaGfaCfdTsdT | 1577 | GfUfcUfcGfgAfaUfu UfgCfgGfcAfgdTsdT | 1578 | 39.00% | 39.70% | 15.60% |
| R-1029 | ugCfcGfcAfaAfuU fcCfgAfgAfcGfdTsdT | 1579 | CfGfuCfuCfgGfaAfu UfuGfcGfgCfadTsdT | 1580 | 28.70% | 18.90% | 30.90% |
| R-1030 | ccCfcAfcUfcAfuGf cUfcUfaCfaAfdTsdT | 1603 | UfUfgUfaGfaGfcAfu GfaGfuGfgGfdTsdT | 1604 | 34.00% | 34.30% | 17.10% |
| R-1031 | agAfuGfgAfuGfuG faAfcCfcCfgAfdTsdT | 1613 | UfCfgGfgGfuUfcAfc AfuCfcAfuCfudTsdT | 1614 | 17.80% | 11.20% | 52.60% |
| R-1032 | cuGfcGfuGfaAfgA faGfuGfuCfcCfdTsdT | 1647 | GfGfgAfcAfcUfuCfu UfcAfcGfcAfgdTsdT | 1648 | 30.50% | 13.40% | 40.40% |
| R-1033 | gaAfgAfaGfuGfuC fcCfcGfuAfaUfdTsdT | 1659 | AfUfuAfcGfgGfgAfc AfcUfuCfuUfcdTsdT | 1660 | 11.10% | 5.90% | 46.80% |
| R-1034 | auGfuGfgUfgAfcA fgAfuCfaCfgGfdTsdT | 1691 | CfCfgUfgAfuCfuGfu CfaCfcAfcAfudTsdT | 1692 | 27.90% | 34.70% | 9.00% |
| R-1035 | ugGfuGfaCfaGfaU fcAfcGfgCfuCfdTsdT | 1693 | GfAfgCfcGfuGfaUfc UfgUfcAfcCfadTsdT | 1694 | 59.00% | 48.80% | 82.20% |
| R-1036 | guGfaCfaGfaUfcAf cGfgCfuCfgUfdTsdT | 1695 | AfCfgAfgCfcGfuGfa UfcUfgUfcAfcdTsdT | 1696 | 21.40% | 27.10% | 91.20% |
| R-1037 | ugAfcAfgAfuCfaC fgGfcUfcGfuGfdTsdT | 1697 | CfAfcGfaGfcCfgUfg AfuCfuGfuCfadTsdT | 1698 | 99.70% | 90.20% | 94.40% |
| R-1038 | gaCfaGfaUfcAfcGf gCfuCfgUfgCfdTsdT | 1699 | GfCfaCfgAfgCfcGfu GfaUfcUfgUfcdTsdT | 1700 | 25.60% | 10.90% | 88.30% |
| R-1039 | acAfgAfuCfaCfgGf cUfcGfuGfcGfdTsdT | 1701 | CfGfcAfcGfaGfcCfg UfgAfuCfuGfudTsdT | 1702 | 94.80% | 98.50% | 95.40% |

TABLE 4-continued

| Avidity ID# | sense strand sequence (5'-3') | SEQ ID NO: | antisense strand sequence (5'-3') | SEQ ID NO: | qPCR, H358, 5 nM % Rel EGFR mRNA | qPCR, H1650, 5 nM % Rel EGFR mRNA | qPCR, H1975, 5 nM % Rel EGFR mRNA |
|---|---|---|---|---|---|---|---|
| R-1040 | caGfaUfcAfcGfgCf uCfgUfgCfgUfdTs dT | 1703 | AfCfgCfaCfgAfgCfc GfuGfaUfcUfgdTsdT | 1704 | 108.70% | 98.10% | 90.00% |
| R-1041 | ucAfcGfgCfuCfgU fgCfgUfcCfgAfdTs dT | 1711 | UfCfgGfaCfgCfaCfg AfgCfcGfuGfadTsdT | 1712 | 93.70% | 76.20% | 38.30% |
| R-1042 | caCfgGfcUfcGfuGf cGfuCfcGfaGfdTsdT | 1713 | CfUfcGfgAfcGfcAfc GfaGfcCfgUfgdTsdT | 1714 | 86.90% | 92.30% | 92.70% |
| R-1043 | gaCfgGfcGfuCfcGf cAfaGfuGfuAfdTs dT | 1729 | UfAfcAfcUfuGfcGfg AfcGfcCfgUfcdTsdT | 1730 | 60.00% | 61.50% | 8.00% |
| R-1044 | acGfgCfgUfcCfgCf aAfgUfgUfaAfdTs dT | 1731 | UfUfaCfaCfuUfgCfg GfaCfgCfcGfudTsdT | 1732 | 21.00% | 36.60% | 90.90% |
| R-1045 | gcGfuCfcGfcAfaGf uGfuAfaGfaAfdTs dT | 1733 | UfUfcUfuAfcAfcUfu GfcGfgAfcGfcdTsdT | 1734 | 32.20% | 21.50% | 101.60% |
| R-1046 | aaGfuGfuAfaGfaA fgUfgCfgAfaGfdTs dT | 1747 | CfUfuCfgCfaCfuUfc UfuAfcAfcUfudTsdT | 1748 | 15.80% | 10.10% | 34.90% |
| R-1047 | cgAfaGfgGfcCfuU fgCfcCfcGfcAfaAfdTs dT | 1771 | UfUfuGfcGfgCfaAfg GfcCfcUfuCfgdTsdT | 1772 | 15.10% | 10.00% | 24.90% |
| R-1048 | aaGfgGfcCfuUfgCf cGfcAfaAfgUfdTs dT | 1773 | AfCfuUfuGfcGfgCfa AfgGfcCfcUfudTsdT | 1774 | 105.00% | 96.80% | 86.90% |
| R-1049 | acCfuCfcAfuCfaGf uGfgCfgAfuCfdTs dT | 1815 | GfAfuCfgCfcAfcUfg AfuGfgAfgGfudTsdT | 1816 | 89.50% | 97.60% | 102.90% |
| R-1050 | cuCfcAfuCfaGfuGf gCfgAfuCfuCfdTs dT | 1817 | GfAfgAfuCfgCfcAfc UfgAfuGfgAfgdTsdT | 1818 | 39.00% | 24.80% | 68.60% |
| R-1051 | gcCfgGfuGfgCfaU fuUfaGfgGfgUfdTs dT | 1843 | AfCfcCfcUfaAfaUfg CfcAfcCfgGfcdTsdT | 1844 | 31.90% | 30.40% | 81.30% |

A list of the relative normalized EGFR mRNA levels, expressed as a percentage of control cells, for the initial single-concentration testing in all three cell lines is presented in Table 4. Of the siRNA candidates tested, four (4) achieved ≥80% down-regulation in all three cell lines tested. Based upon results obtained from this initial single-concentration experiment, we selected a total of four (4) candidate siRNAs (hs ID #333, #603, #622, and #685) for multi-concentration testing, which allowed determination of IC$_{50}$ (i.e., the concentration required to reduce EGFR expression by 50%), in each of these three cell lines. Cells were transfected as above at concentrations starting from 5000 pM using serial dilutions. 48 hours post-transfection, RNA was harvested and normalized EGFR mRNA levels were quantified as described above. Results are presented in Table 5, and all four siRNAs had comparable potency in term of silencing the mRNA target.

TABLE 5

| Avidity ID# | qPCR, H358, IC50, pM | qPCR, H1650, IC50, pM | qPCR, H1975, IC50, pM | Viability H358, IC50, pM | Viability, H1975, IC50, pM |
|---|---|---|---|---|---|
| R-1006 | 21 | 3.5 | 181 | 395 | 21 |
| R-1010 | 17 | 7 | 131 | | |
| R-1018 | 21 | 10.4 | 99 | | |
| R-1011 | 30 | 10.6 | 103 | 195 | 24 | hs ID #333 and #622 were evaluated to see if reduction in EGFR mRNA resulted in reduced cell viability. Knocking down EGFR mRNA is known to affect cell viability and proliferation, particularly in cell lines carrying EGFR activating mutations, such as H1975. 3000 H358 and H1975 cells were plated in 384-well plates and increasing concentrations of siRNA-#333 and #622 in the presence with RNAiMAX were added to the cell culture. At 4 days post transfection, new media and siRNAs with transfection reagent were added to the cell culture plates. After a total of seven days (3 days post $2^{nd}$ transfection), cell viability was assessed with CellTiter-Blue® (Promega), according to the manufacturer's instructions and is reported in table 2. Knocking down EGFR mRNA, as shown in table 2, had a dramatic effect on cell viability on both cell lines.

Next, an array of chemical modification patterns were introduced to siRNA-#333 (Table 6) and their effect on EGFR mRNA were tested in H358 and H1975 cells after transfection with RNAiMAX as described above. Modification patterns used in R-1068 and R-1105 caused significant activity loss while the others showed comparable $IC_{50}$ values to the original siRNA-#333 in both cell lines tested.

TABLE 6

| Avidity ID | sense strand sequence (5'-3') | SEQ ID NO: | antisense strand sequence (5'-3') | SEQ ID NO: | qPCR, H358, IC50, pM | qPCR, H1650, IC50, pM |
|---|---|---|---|---|---|---|
| R-1067 | AGUUUGCCAAGGCA CGAGUdTsdT | 1881 | ACUCGUGCCUUG GCAAACUdTsdT | 1882 | 12.7 | 167.7 |
| R-1068 | AaguuuGccAAGGcacGA GudTsdT | 1883 | ACUCGUGCCUUG GcAAACUdTsdT | 1884 | 304.8 | >1000 |
| R-1102 | iBagUfuUfgCfcAfaGfgC faCfgAfgUfdTsdTiB | 1885 | AfCfuCfgUfgCfcUfu GfgCfaAfaCfudTsdT | 1886 | 18.7 | 95.3 |
| R-1103 | iBagUfuUfgCfcAfaGfgC faCfgAfgUfdTsdTiB | 1887 | AfsCfsusCfgUfgCfc UfuGfgCfaAfaCfudT sdT | 1888 | 48.4 | 99.1 |
| R-1104 | iBagUfuUfgCfcAfaGfgC faCfgAfgUfdTsdTiB | 1889 | aCfuCfgUfgCfcUfuG fgCfaAfaCfudTsdT | 1890 | 60.5 | 145.9 |
| R-1105 | iBagUfuUfgCfcAfaGfgC faCfgAfgUfdTsdTiB | 1891 | asCfsusCfgUfgCfcUf uGfgCfaAfaCfudTsdT | 1892 | 167.4 | 546.7 |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (1893 sequences)

SEQ ID NO: 1 - RNA, 23 nt, Homo sapiens
ggcggccggagucccgagcuagc

SEQ ID NO: 2 - RNA, 23 nt, Homo sapiens
ggccggagucccgagcuagcccc

SEQ ID NO: 3 - RNA, 23 nt, Homo sapiens
gccggagucccgagcuagccccg

SEQ ID NO: 4 - RNA, 23 nt, Homo sapiens
ccggagucccgagcuagccccgg

SEQ ID NO: 5 - RNA, 23 nt, Homo sapiens
cggagucccgagcuagccccggc

SEQ ID NO: 6 - RNA, 23 nt, Homo sapiens
ggagucccgagcuagccccggcg

SEQ ID NO: 7 - RNA, 23 nt, Homo sapiens
gagucccgagcuagccccggcgg

SEQ ID NO: 8 - RNA, 23 nt, Homo sapiens
gucccgagcuagccccggcggcc

SEQ ID NO: 9 - RNA, 23 nt, Homo sapiens
ccggacgacaggccaccucgucg

SEQ ID NO: 10 - RNA, 23 nt, Homo sapiens
cggacgacaggccaccucgucgg

SEQ ID NO: 11 - RNA, 23 nt, Homo sapiens
ggacgacaggccaccucgucggc

SEQ ID NO: 12 - RNA, 23 nt, Homo sapiens
gacgacaggccaccucgucggcg

SEQ ID NO: 13 - RNA, 23 nt, Homo sapiens
acgacaggccaccucgucggcgu

SEQ ID NO: 14 - RNA, 23 nt, Homo sapiens
gacaggccaccucgucggcgucc

SEQ ID NO: 15 - RNA, 23 nt, Homo sapiens
acaggccaccucgucggcguccg

SEQ ID NO: 16 - RNA, 23 nt, Homo sapiens
caggccaccucgucggcguccgc

SEQ ID NO: 17 - RNA, 23 nt, Homo sapiens
aggccaccucgucggcguccgcc

SEQ ID NO: 18 - RNA, 23 nt, Homo sapiens
ggccaccucgucggcguccgccc

SEQ ID NO: 19 - RNA, 23 nt, Homo sapiens
gccaccucgucggcguccgcccg

SEQ ID NO: 20 - RNA, 23 nt, Homo sapiens
ccaccucgucggcguccgcccga

SEQ ID NO: 21 - RNA, 23 nt, Homo sapiens
caccucgucggcguccgcccgag

SEQ ID NO: 22 - RNA, 23 nt, Homo sapiens
accucgucggcguccgcccgagu

SEQ ID NO: 23 - RNA, 23 nt, Homo sapiens
ccucgucggcguccgcccgaguc

SEQ ID NO: 24 - RNA, 23 nt, Homo sapiens
cucgucggcguccgcccgagucc

SEQ ID NO: 25 - RNA, 23 nt, Homo sapiens
ucgucggcguccgcccgaguccc

SEQ ID NO: 26 - RNA, 23 nt, Homo sapiens
cgucggcguccgcccgagucccc

SEQ ID NO: 27 - RNA, 23 nt, Homo sapiens
cggcguccgcccgaguccccgcc

SEQ ID NO: 28 - RNA, 23 nt, Homo sapiens
ggcguccgcccgaguccccgccu

SEQ ID NO: 29 - RNA, 23 nt, Homo sapiens
ccgcccgaguccccgccucgccg

SEQ ID NO: 30 - RNA, 23 nt, Homo sapiens
ccaacgccacaaccaccgcgcac

SEQ ID NO: 31 - RNA, 23 nt, Homo sapiens
caacgccacaaccaccgcgcacg

SEQ ID NO: 32 - RNA, 23 nt, Homo sapiens
aacgccacaaccaccgcgcacgg

SEQ ID NO: 33 - RNA, 23 nt, Homo sapiens
cgccacaaccaccgcgcacggcc

SEQ ID NO: 34 - RNA, 23 nt, Homo sapiens
gccacaaccaccgcgcacggccc

SEQ ID NO: 35 - RNA, 23 nt, Homo sapiens
ccacaaccaccgcgcacggcccc

SEQ ID NO: 36 - RNA, 23 nt, Homo sapiens
cgaugcgacccuccgggacggcc

SEQ ID NO: 37 - RNA, 23 nt, Homo sapiens
gaugcgacccuccgggacggccg

SEQ ID NO: 38 - RNA, 23 nt, Homo sapiens
augcgacccuccgggacggccgg

SEQ ID NO: 39 - RNA, 23 nt, Homo sapiens
gcgacccuccgggacggccgggg

SEQ ID NO: 40 - RNA, 23 nt, Homo sapiens
cgacccuccgggacggccggggc

SEQ ID NO: 41 - RNA, 23 nt, Homo sapiens
acccuccgggacggccggggcag

SEQ ID NO: 42 - RNA, 23 nt, Homo sapiens
aaagaaaguuugccaaggcacga

SEQ ID NO: 43 - RNA, 23 nt, Homo sapiens
aagaaaguuugccaaggcacgag

SEQ ID NO: 44 - RNA, 23 nt, Homo sapiens
gaaaguuugccaaggcacgagua

SEQ ID NO: 45 - RNA, 23 nt, Homo sapiens
aaaguuugccaaggcacgaguaa

SEQ ID NO: 46 - RNA, 23 nt, Homo sapiens
aaguuugccaaggcacgaguaac

SEQ ID NO: 47 - RNA, 23 nt, Homo sapiens
aguuugccaaggcacgaguaaca

SEQ ID NO: 48 - RNA, 23 nt, Homo sapiens
guuugccaaggcacgaguaacaa

SEQ ID NO: 49 - RNA, 23 nt, Homo sapiens
uuugccaaggcacgaguaacaag

SEQ ID NO: 50 - RNA, 23 nt, Homo sapiens
uugccaaggcacgaguaacaagc

SEQ ID NO: 51 - RNA, 23 nt, Homo sapiens
ucacgcaguugggcacuuuugaa

SEQ ID NO: 52 - RNA, 23 nt, Homo sapiens
cacgcaguugggcacuuuugaag

SEQ ID NO: 53 - RNA, 23 nt, Homo sapiens
acgcaguugggcacuuuugaaga

SEQ ID NO: 54 - RNA, 23 nt, Homo sapiens
cgcaguugggcacuuuugaagau

SEQ ID NO: 55 - RNA, 23 nt, Homo sapiens
gcaguugggcacuuuugaagauc

SEQ ID NO: 56 - RNA, 23 nt, Homo sapiens
caguugggcacuuuugaagauca

SEQ ID NO: 57 - RNA, 23 nt, Homo sapiens
aguugggcacuuuugaagaucau

SEQ ID NO: 58 - RNA, 23 nt, Homo sapiens
guugggcacuuuugaagaucauu

SEQ ID NO: 59 - RNA, 23 nt, Homo sapiens
uugggcacuuuugaagaucauuu

SEQ ID NO: 60 - RNA, 23 nt, Homo sapiens
uuuugaagaucauuuucucagcc

SEQ ID NO: 61 - RNA, 23 nt, Homo sapiens
uugaagaucauuuucucagccuc

SEQ ID NO: 62 - RNA, 23 nt, Homo sapiens
ugaagaucauuuucucagccucc

SEQ ID NO: 63 - RNA, 23 nt, Homo sapiens
aucauuuucucagccuccagagg

SEQ ID NO: 64 - RNA, 23 nt, Homo sapiens
ucagccuccagaggauguucaau

SEQ ID NO: 65 - RNA, 23 nt, Homo sapiens
agccuccagaggauguucaauaa

SEQ ID NO: 66 - RNA, 23 nt, Homo sapiens
gccuccagaggauguucaauaac

SEQ ID NO: 67 - RNA, 23 nt, Homo sapiens
ccagaggauguucaauaacugug

SEQ ID NO: 68 - RNA, 23 nt, Homo sapiens
agaggauguucaauaacugugag

SEQ ID NO: 69 - RNA, 23 nt, Homo sapiens
gauguucaauaacugugaggugg

SEQ ID NO: 70 - RNA, 23 nt, Homo sapiens
uguucaauaacugugaggugguc

SEQ ID NO: 71 - RNA, 23 nt, Homo sapiens
guucaauaacugugagguggucc

SEQ ID NO: 72 - RNA, 23 nt, Homo sapiens
uucaauaacugugaggugguccu

SEQ ID NO: 73 - RNA, 23 nt, Homo sapiens
ucaauaacugugaggugguccuu

SEQ ID NO: 74 - RNA, 23 nt, Homo sapiens
caauaacugugaggugguccuug

SEQ ID NO: 75 - RNA, 23 nt, Homo sapiens
aauaacugugaggugguccuugg

SEQ ID NO: 76 - RNA, 23 nt, Homo sapiens
uaacugugaggugguccuuggga

SEQ ID NO: 77 - RNA, 23 nt, Homo sapiens
acugugaggugguccuugggaau

SEQ ID NO: 78 - RNA, 23 nt, Homo sapiens
cugugaggugguccuugggaauu

SEQ ID NO: 79 - RNA, 23 nt, Homo sapiens
ggugguccuugggaauuuggaaa

SEQ ID NO: 80 - RNA, 23 nt, Homo sapiens
ccuugggaauuuggaaauuaccu

SEQ ID NO: 81 - RNA, 23 nt, Homo sapiens
cuugggaauuuggaaauuaccua

SEQ ID NO: 82 - RNA, 23 nt, Homo sapiens
uugggaauuuggaaauuaccuau

SEQ ID NO: 83 - RNA, 23 nt, Homo sapiens
ugggaauuuggaaauuaccuaug

SEQ ID NO: 84 - RNA, 23 nt, Homo sapiens
gcagaggaauuaugaucuuuccu

SEQ ID NO: 85 - RNA, 23 nt, Homo sapiens
cagaggaauuaugaucuuuccuu

SEQ ID NO: 86 - RNA, 23 nt, Homo sapiens
ggaauuaugaucuuuccuucuua

SEQ ID NO: 87 - RNA, 23 nt, Homo sapiens
gaauuaugaucuuuccuucuuaa

SEQ ID NO: 88 - RNA, 23 nt, Homo sapiens
auuaugaucuuuccuucuuaaag

SEQ ID NO: 89 - RNA, 23 nt, Homo sapiens
uaugaucuuuccuucuuaaagac

SEQ ID NO: 90 - RNA, 23 nt, Homo sapiens
gaucuuuccuucuuaaagaccau

SEQ ID NO: 91 - RNA, 23 nt, Homo sapiens
uuccuucuuaaagaccauccagg

SEQ ID NO: 92 - RNA, 23 nt, Homo sapiens
uccuucuuaaagaccauccagga

SEQ ID NO: 93 - RNA, 23 nt, Homo sapiens
cuucuuaaagaccauccaggagg

SEQ ID NO: 94 - RNA, 23 nt, Homo sapiens
ucuuaaagaccauccaggaggug

SEQ ID NO: 95 - RNA, 23 nt, Homo sapiens
cuuaaagaccauccaggaggugg

SEQ ID NO: 96 - RNA, 23 nt, Homo sapiens
auccaggagguggcugguuaugu

SEQ ID NO: 97 - RNA, 23 nt, Homo sapiens
uccaggagguggcugguuauguc

SEQ ID NO: 98 - RNA, 23 nt, Homo sapiens
ccaggagguggcugguuaugucc

SEQ ID NO: 99 - RNA, 23 nt, Homo sapiens
caggagguggcugguuauguccu

SEQ ID NO: 100 - RNA, 23 nt, Homo sapiens
aggagguggcugguuauguccuc

SEQ ID NO: 101 - RNA, 23 nt, Homo sapiens
ggagguggcugguuauguccuca

SEQ ID NO: 102 - RNA, 23 nt, Homo sapiens
agguggcugguuauguccucauu

SEQ ID NO: 103 - RNA, 23 nt, Homo sapiens
uugcccucaacacaguggagcga

SEQ ID NO: 104 - RNA, 23 nt, Homo sapiens
aauuccuuuggaaaaccugcaga

SEQ ID NO: 105 - RNA, 23 nt, Homo sapiens
auuccuuuggaaaaccugcagau

SEQ ID NO: 106 - RNA, 23 nt, Homo sapiens
uggaaaaccugcagaucaucaga

SEQ ID NO: 107 - RNA, 23 nt, Homo sapiens
ggaaaaccugcagaucaucagag

SEQ ID NO: 108 - RNA, 23 nt, Homo sapiens
aaaaccugcagaucaucagagga

SEQ ID NO: 109 - RNA, 23 nt, Homo sapiens
accugcagaucaucagaggaaau

SEQ ID NO: 110 - RNA, 23 nt, Homo sapiens
acgaaaauuccuaugccuuagca

SEQ ID NO: 111 - RNA, 23 nt, Homo sapiens
cgaaaauuccuaugccuuagcag

SEQ ID NO: 112 - RNA, 23 nt, Homo sapiens
aaaauuccuaugccuuagcaguc

SEQ ID NO: 113 - RNA, 23 nt, Homo sapiens
auuccuaugccuuagcagucuua

SEQ ID NO: 114 - RNA, 23 nt, Homo sapiens
uuccuaugccuuagcagucuuau

SEQ ID NO: 115 - RNA, 23 nt, Homo sapiens
uccuaugccuuagcagucuuauc

SEQ ID NO: 116 - RNA, 23 nt, Homo sapiens
cuaugccuuagcagucuuaucua

SEQ ID NO: 117 - RNA, 23 nt, Homo sapiens
uaugccuuagcagucuuaucuaa

SEQ ID NO: 118 - RNA, 23 nt, Homo sapiens
augccuuagcagucuuaucuaac

SEQ ID NO: 119 - RNA, 23 nt, Homo sapiens
ugccuuagcagucuuaucuaacu

SEQ ID NO: 120 - RNA, 23 nt, Homo sapiens
gccuuagcagucuuaucuaacua

SEQ ID NO: 121 - RNA, 23 nt, Homo sapiens
ccuuagcagucuuaucuaacuau

SEQ ID NO: 122 - RNA, 23 nt, Homo sapiens
cuuagcagucuuaucuaacuaug

SEQ ID NO: 123 - RNA, 23 nt, Homo sapiens
uuagcagucuuaucuaacuauga

SEQ ID NO: 124 - RNA, 23 nt, Homo sapiens
uagcagucuuaucuaacuaugau

SEQ ID NO: 125 - RNA, 23 nt, Homo sapiens
agcagucuuaucuaacuaugaug

SEQ ID NO: 126 - RNA, 23 nt, Homo sapiens
agucuuaucuaacuaugaugcaa

SEQ ID NO: 127 - RNA, 23 nt, Homo sapiens
gucuuaucuaacuaugaugcaaa

SEQ ID NO: 128 - RNA, 23 nt, Homo sapiens
ucuuaucuaacuaugaugcaaau

SEQ ID NO: 129 - RNA, 23 nt, Homo sapiens
cuuaucuaacuaugaugcaaaua

SEQ ID NO: 130 - RNA, 23 nt, Homo sapiens
uuaucuaacuaugaugcaaauaa

SEQ ID NO: 131 - RNA, 23 nt, Homo sapiens
uaucuaacuaugaugcaaauaaa

SEQ ID NO: 132 - RNA, 23 nt, Homo sapiens
aucuaacuaugaugcaaauaaaa

SEQ ID NO: 133 - RNA, 23 nt, Homo sapiens
cuaacuaugaugcaaauaaaacc

SEQ ID NO: 134 - RNA, 23 nt, Homo sapiens
augaugcaaauaaaaccggacug

SEQ ID NO: 135 - RNA, 23 nt, Homo sapiens
ugaugcaaauaaaaccggacuga

SEQ ID NO: 136 - RNA, 23 nt, Homo sapiens
gaugcaaauaaaaccggacugaa

SEQ ID NO: 137 - RNA, 23 nt, Homo sapiens
ugcaaauaaaaccggacugaagg

SEQ ID NO: 138 - RNA, 23 nt, Homo sapiens
gcaaauaaaaccggacugaagga

SEQ ID NO: 139 - RNA, 23 nt, Homo sapiens
caaauaaaaccggacugaaggag

SEQ ID NO: 140 - RNA, 23 nt, Homo sapiens
aauaaaaccggacugaaggagcu

SEQ ID NO: 141 - RNA, 23 nt, Homo sapiens
auaaaaccggacugaaggagcug

SEQ ID NO: 142 - RNA, 23 nt, Homo sapiens
uaaaaccggacugaaggagcugc

SEQ ID NO: 143 - RNA, 23 nt, Homo sapiens
aaaaccggacugaaggagcugcc

SEQ ID NO: 144 - RNA, 23 nt, Homo sapiens
gaaggagcugcccaugagaaauu

SEQ ID NO: 145 - RNA, 23 nt, Homo sapiens
uuuacaggaaauccugcauggcg

SEQ ID NO: 146 - RNA, 23 nt, Homo sapiens
acaggaaauccugcauggcgccg

SEQ ID NO: 147 - RNA, 23 nt, Homo sapiens
caggaaauccugcauggcgccgu

SEQ ID NO: 148 - RNA, 23 nt, Homo sapiens
aggaaauccugcauggcgccgug

SEQ ID NO: 149 - RNA, 23 nt, Homo sapiens
ggaaauccugcauggcgccgugc

SEQ ID NO: 150 - RNA, 23 nt, Homo sapiens
gaaauccugcauggcgccgugcg

SEQ ID NO: 151 - RNA, 23 nt, Homo sapiens
aauccugcauggcgccgugcggu

SEQ ID NO: 152 - RNA, 23 nt, Homo sapiens
uccugcauggcgccgugcgguuc

SEQ ID NO: 153 - RNA, 23 nt, Homo sapiens
ccugcauggcgccgugcgguuca

SEQ ID NO: 154 - RNA, 23 nt, Homo sapiens
cugcauggcgccgugcgguucag

SEQ ID NO: 155 - RNA, 23 nt, Homo sapiens
gcauggcgccgugcgguucagca

SEQ ID NO: 156 - RNA, 23 nt, Homo sapiens
cauggcgccgugcgguucagcaa

SEQ ID NO: 157 - RNA, 23 nt, Homo sapiens
auggcgccgugcgguucagcaac

SEQ ID NO: 158 - RNA, 23 nt, Homo sapiens
uggcgccgugcgguucagcaaca

SEQ ID NO: 159 - RNA, 23 nt, Homo sapiens
ggcgccgugcgguucagcaacaa

SEQ ID NO: 160 - RNA, 23 nt, Homo sapiens
gcgccgugcgguucagcaacaac

SEQ ID NO: 161 - RNA, 23 nt, Homo sapiens
cgccgugcgguucagcaacaacc

SEQ ID NO: 162 - RNA, 23 nt, Homo sapiens
ccgugcgguucagcaacaacccu

SEQ ID NO: 163 - RNA, 23 nt, Homo sapiens
gugcgguucagcaacaacccugc

SEQ ID NO: 164 - RNA, 23 nt, Homo sapiens
gcgguucagcaacaacccugccc

SEQ ID NO: 165 - RNA, 23 nt, Homo sapiens
cagcaacaacccugcccugugca

SEQ ID NO: 166 - RNA, 23 nt, Homo sapiens
gcaacaacccugcccugugcaac

SEQ ID NO: 167 - RNA, 23 nt, Homo sapiens
caacguggagagcauccaguggc

SEQ ID NO: 168 - RNA, 23 nt, Homo sapiens
aacguggagagcauccaguggcg

SEQ ID NO: 169 - RNA, 23 nt, Homo sapiens
acguggagagcauccaguggcgg

SEQ ID NO: 170 - RNA, 23 nt, Homo sapiens
uggagagcauccaguggcgggac

SEQ ID NO: 171 - RNA, 23 nt, Homo sapiens
ggagagcauccaguggcgggaca

SEQ ID NO: 172 - RNA, 23 nt, Homo sapiens
gagagcauccaguggcgggacau

SEQ ID NO: 173 - RNA, 23 nt, Homo sapiens
uccaguggcgggacauagucagc

SEQ ID NO: 174 - RNA, 23 nt, Homo sapiens
ccaguggcgggacauagucagca

SEQ ID NO: 175 - RNA, 23 nt, Homo sapiens
aguggcgggacauagucagcagu

SEQ ID NO: 176 - RNA, 23 nt, Homo sapiens
guggcgggacauagucagcagug

SEQ ID NO: 177 - RNA, 23 nt, Homo sapiens
uucucagcaacaugucgauggac

SEQ ID NO: 178 - RNA, 23 nt, Homo sapiens
cucagcaacaugucgauggacuu

SEQ ID NO: 179 - RNA, 23 nt, Homo sapiens
ucagcaacaugucgauggacuuc

SEQ ID NO: 180 - RNA, 23 nt, Homo sapiens
cagcaacaugucgauggacuucc

SEQ ID NO: 181 - RNA, 23 nt, Homo sapiens
gcaacaugucgauggacuuccag

SEQ ID NO: 182 - RNA, 23 nt, Homo sapiens
caacaugucgauggacuuccaga

SEQ ID NO: 183 - RNA, 23 nt, Homo sapiens
aacaugucgauggacuuccagaa

SEQ ID NO: 184 - RNA, 23 nt, Homo sapiens
acaugucgauggacuuccagaac

SEQ ID NO: 185 - RNA, 23 nt, Homo sapiens
ugucgauggacuuccagaaccac

SEQ ID NO: 186 - RNA, 23 nt, Homo sapiens
cagaaccaccugggcagcugcca

SEQ ID NO: 187 - RNA, 23 nt, Homo sapiens
cugggcagcugccaaaaguguga

SEQ ID NO: 188 - RNA, 23 nt, Homo sapiens
gggcagcugccaaaagugugauc

SEQ ID NO: 189 - RNA, 23 nt, Homo sapiens
gcugccaaaagugugauccaagc

SEQ ID NO: 190 - RNA, 23 nt, Homo sapiens
cugccaaaagugugauccaagcu

SEQ ID NO: 191 - RNA, 23 nt, Homo sapiens
ugccaaaagugugauccaagcug

SEQ ID NO: 192 - RNA, 23 nt, Homo sapiens
caaaagugugauccaagcugucc

SEQ ID NO: 193 - RNA, 23 nt, Homo sapiens
agugugauccaagcugucccaau

SEQ ID NO: 194 - RNA, 23 nt, Homo sapiens
gugugauccaagcugucccaaug

SEQ ID NO: 195 - RNA, 23 nt, Homo sapiens
gugauccaagcugucccaauggg

SEQ ID NO: 196 - RNA, 23 nt, Homo sapiens
ugauccaagcugucccaauggga

SEQ ID NO: 197 - RNA, 23 nt, Homo sapiens
gauccaagcugucccaaugggag

SEQ ID NO: 198 - RNA, 23 nt, Homo sapiens
auccaagcugucccaaugggagc

SEQ ID NO: 199 - RNA, 23 nt, Homo sapiens
uccaagcugucccaaugggagcu

SEQ ID NO: 200 - RNA, 23 nt, Homo sapiens
caagcugucccaaugggagcugc

SEQ ID NO: 201 - RNA, 23 nt, Homo sapiens
gcugucccaaugggagcugcugg

SEQ ID NO: 202 - RNA, 23 nt, Homo sapiens
ggggugcaggagaggagaacugc

SEQ ID NO: 203 - RNA, 23 nt, Homo sapiens
agaaacugaccaaaaucaucugu

SEQ ID NO: 204 - RNA, 23 nt, Homo sapiens
gaaacugaccaaaaucaucugug

SEQ ID NO: 205 - RNA, 23 nt, Homo sapiens
aaacugaccaaaaucaucugugc

SEQ ID NO: 206 - RNA, 23 nt, Homo sapiens
ugaccaaaaucaucugugcccag

SEQ ID NO: 207 - RNA, 23 nt, Homo sapiens
gaccaaaaucaucugugcccagc

SEQ ID NO: 208 - RNA, 23 nt, Homo sapiens
caaaaucaucugugcccagcagu

SEQ ID NO: 209 - RNA, 23 nt, Homo sapiens
cugugcccagcagugcuccgggc

SEQ ID NO: 210 - RNA, 23 nt, Homo sapiens
gugcccagcagugcuccgggcgc

SEQ ID NO: 211 - RNA, 23 nt, Homo sapiens
ccccagugacugcugccacaacc

SEQ ID NO: 212 - RNA, 23 nt, Homo sapiens
cccagugacugcugccacaacca

SEQ ID NO: 213 - RNA, 23 nt, Homo sapiens
gggagagcgacugccuggucugc

SEQ ID NO: 214 - RNA, 23 nt, Homo sapiens
ggagagcgacugccuggucugcc

SEQ ID NO: 215 - RNA, 23 nt, Homo sapiens
gagagcgacugccuggucugccg

SEQ ID NO: 216 - RNA, 23 nt, Homo sapiens
agagcgacugccuggucugccgc

SEQ ID NO: 217 - RNA, 23 nt, Homo sapiens
gagcgacugccuggucugccgca

SEQ ID NO: 218 - RNA, 23 nt, Homo sapiens
agcgacugccuggucugccgcaa

SEQ ID NO: 219 - RNA, 23 nt, Homo sapiens
cugccuggucugccgcaaauucc

SEQ ID NO: 220 - RNA, 23 nt, Homo sapiens
ugccuggucugccgcaaauuccg

SEQ ID NO: 221 - RNA, 23 nt, Homo sapiens
gccuggucugccgcaaauuccga

SEQ ID NO: 222 - RNA, 23 nt, Homo sapiens
ccuggucugccgcaaauuccgag

SEQ ID NO: 223 - RNA, 23 nt, Homo sapiens
uggucugccgcaaauuccgagac

SEQ ID NO: 224 - RNA, 23 nt, Homo sapiens
ggucugccgcaaauuccgagacg

SEQ ID NO: 225 - RNA, 23 nt, Homo sapiens
gucugccgcaaauuccgagacga

SEQ ID NO: 226 - RNA, 23 nt, Homo sapiens
ucugccgcaaauuccgagacgaa

SEQ ID NO: 227 - RNA, 23 nt, Homo sapiens
ugccgcaaauuccgagacgaagc

SEQ ID NO: 228 - RNA, 23 nt, Homo sapiens
caaauuccgagacgaagccacgu

SEQ ID NO: 229 - RNA, 23 nt, Homo sapiens
aaauuccgagacgaagccacgug

SEQ ID NO: 230 - RNA, 23 nt, Homo sapiens
aauuccgagacgaagccacgugc

SEQ ID NO: 231 - RNA, 23 nt, Homo sapiens
auuccgagacgaagccacgugca

SEQ ID NO: 232 - RNA, 23 nt, Homo sapiens
uuccgagacgaagccacgugcaa

SEQ ID NO: 233 - RNA, 23 nt, Homo sapiens
ccgagacgaagccacgugcaagg

SEQ ID NO: 234 - RNA, 23 nt, Homo sapiens
agacgaagccacgugcaaggaca

SEQ ID NO: 235 - RNA, 23 nt, Homo sapiens
gacgaagccacgugcaaggacac

SEQ ID NO: 236 - RNA, 23 nt, Homo sapiens
acgaagccacgugcaaggacacc

SEQ ID NO: 237 - RNA, 23 nt, Homo sapiens
cgaagccacgugcaaggacaccu

SEQ ID NO: 238 - RNA, 23 nt, Homo sapiens
ccccccacucaugcucuacaacc

SEQ ID NO: 239 - RNA, 23 nt, Homo sapiens
ccccacucaugcucuacaacccc

SEQ ID NO: 240 - RNA, 23 nt, Homo sapiens
ccacucaugcucuacaaccccac

SEQ ID NO: 241 - RNA, 23 nt, Homo sapiens
cucaugcucuacaaccccaccac

SEQ ID NO: 242 - RNA, 23 nt, Homo sapiens
uaccagauggaugugaaccccga

SEQ ID NO: 243 - RNA, 23 nt, Homo sapiens
ccagauggaugugaaccccgagg

SEQ ID NO: 244 - RNA, 23 nt, Homo sapiens
cagauggaugugaaccccgaggg

SEQ ID NO: 245 - RNA, 23 nt, Homo sapiens
agauggaugugaaccccgagggc

SEQ ID NO: 246 - RNA, 23 nt, Homo sapiens
auggaugugaaccccgagggcaa

SEQ ID NO: 247 - RNA, 23 nt, Homo sapiens
uggaugugaaccccgagggcaaa

SEQ ID NO: 248 - RNA, 23 nt, Homo sapiens
gaugugaaccccgagggcaaaua

SEQ ID NO: 249 - RNA, 23 nt, Homo sapiens
ugaaccccgagggcaaauacagc

SEQ ID NO: 250 - RNA, 23 nt, Homo sapiens
gaaccccgagggcaaauacagcu

SEQ ID NO: 251 - RNA, 23 nt, Homo sapiens
accccgagggcaaauacagcuuu

SEQ ID NO: 252 - RNA, 23 nt, Homo sapiens
ccccgagggcaaauacagcuuug

SEQ ID NO: 253 - RNA, 23 nt, Homo sapiens
cccgagggcaaauacagcuuugg

SEQ ID NO: 254 - RNA, 23 nt, Homo sapiens
gcaaauacagcuuuggugccacc

SEQ ID NO: 255 - RNA, 23 nt, Homo sapiens
caaauacagcuuuggugccaccu

SEQ ID NO: 256 - RNA, 23 nt, Homo sapiens
aaauacagcuuuggugccaccug

SEQ ID NO: 257 - RNA, 23 nt, Homo sapiens
agcuuuggugccaccugcgugaa

SEQ ID NO: 258 - RNA, 23 nt, Homo sapiens
cuuuggugccaccugcgugaaga

SEQ ID NO: 259 - RNA, 23 nt, Homo sapiens
ugccaccugcgugaagaaguguc

SEQ ID NO: 260 - RNA, 23 nt, Homo sapiens
accugcgugaagaaguguccccg

SEQ ID NO: 261 - RNA, 23 nt, Homo sapiens
ccugcgugaagaaguguccccgu

SEQ ID NO: 262 - RNA, 23 nt, Homo sapiens
cugcgugaagaaguguccccgua

SEQ ID NO: 263 - RNA, 23 nt, Homo sapiens
ugcgugaagaaguguccccguaa

SEQ ID NO: 264 - RNA, 23 nt, Homo sapiens
gcgugaagaaguguccccguaau

SEQ ID NO: 265 - RNA, 23 nt, Homo sapiens
cgugaagaaguguccccguaauu

SEQ ID NO: 266 - RNA, 23 nt, Homo sapiens
gugaagaaguguccccguaauua

SEQ ID NO: 267 - RNA, 23 nt, Homo sapiens
ugaagaaguguccccguaauuau

SEQ ID NO: 268 - RNA, 23 nt, Homo sapiens
gaagaaguguccccguaauuaug

SEQ ID NO: 269 - RNA, 23 nt, Homo sapiens
aagaaguguccccguaauuaugu

SEQ ID NO: 270 - RNA, 23 nt, Homo sapiens
agaaguguccccguaauuaugug

SEQ ID NO: 271 - RNA, 23 nt, Homo sapiens
gaaguguccccguaauuaugugg

SEQ ID NO: 272 - RNA, 23 nt, Homo sapiens
aaguguccccguaauuauguggu

SEQ ID NO: 273 - RNA, 23 nt, Homo sapiens
aguguccccguaauuauguggug

SEQ ID NO: 274 - RNA, 23 nt, Homo sapiens
guguccccguaauuaugugguga

SEQ ID NO: 275 - RNA, 23 nt, Homo sapiens
guccccguaauuauguggugaca

SEQ ID NO: 276 - RNA, 23 nt, Homo sapiens
ccccguaauuauguggugacaga

SEQ ID NO: 277 - RNA, 23 nt, Homo sapiens
ccguaauuauguggugacagauc

SEQ ID NO: 278 - RNA, 23 nt, Homo sapiens
cguaauuauguggugacagauca

SEQ ID NO: 279 - RNA, 23 nt, Homo sapiens
guaauuauguggugacagaucac

SEQ ID NO: 280 - RNA, 23 nt, Homo sapiens
uaauuauguggugacagaucacg

SEQ ID NO: 281 - RNA, 23 nt, Homo sapiens
aauuauguggugacagaucacgg

SEQ ID NO: 282 - RNA, 23 nt, Homo sapiens
uuauguggugacagaucacggcu

SEQ ID NO: 283 - RNA, 23 nt, Homo sapiens
uguggugacagaucacggcucgu

SEQ ID NO: 284 - RNA, 23 nt, Homo sapiens
uggugacagaucacggcucgugc

SEQ ID NO: 285 - RNA, 23 nt, Homo sapiens
ggugacagaucacggcucgugcg

SEQ ID NO: 286 - RNA, 23 nt, Homo sapiens
gugacagaucacggcucgugcgu

SEQ ID NO: 287 - RNA, 23 nt, Homo sapiens
ugacagaucacggcucgugcguc

SEQ ID NO: 288 - RNA, 23 nt, Homo sapiens
gacagaucacggcucgugcgucc

SEQ ID NO: 289 - RNA, 23 nt, Homo sapiens
acagaucacggcucgugcguccg

SEQ ID NO: 290 - RNA, 23 nt, Homo sapiens
cagaucacggcucgugcguccga

SEQ ID NO: 291 - RNA, 23 nt, Homo sapiens
agaucacggcucgugcguccgag

SEQ ID NO: 292 - RNA, 23 nt, Homo sapiens
gaucacggcucgugcguccgagc

SEQ ID NO: 293 - RNA, 23 nt, Homo sapiens
aucacggcucgugcguccgagcc

SEQ ID NO: 294 - RNA, 23 nt, Homo sapiens
ucacggcucgugcguccgagccu

SEQ ID NO: 295 - RNA, 23 nt, Homo sapiens
cggcucgugcguccgagccugug

SEQ ID NO: 296 - RNA, 23 nt, Homo sapiens
auggaggaagacggcguccgcaa

SEQ ID NO: 297 - RNA, 23 nt, Homo sapiens
uggaggaagacggcguccgcaag

SEQ ID NO: 298 - RNA, 23 nt, Homo sapiens
gaggaagacggcguccgcaagug

SEQ ID NO: 299 - RNA, 23 nt, Homo sapiens
aggaagacggcguccgcaagugu

SEQ ID NO: 300 - RNA, 23 nt, Homo sapiens
ggaagacggcguccgcaagugua

SEQ ID NO: 301 - RNA, 23 nt, Homo sapiens
aagacggcguccgcaaguguaag

SEQ ID NO: 302 - RNA, 23 nt, Homo sapiens
agacggcguccgcaaguguaaga

SEQ ID NO: 303 - RNA, 23 nt, Homo sapiens
cggcguccgcaaguguaagaagu

SEQ ID NO: 304 - RNA, 23 nt, Homo sapiens
ggcguccgcaaguguaagaagug

SEQ ID NO: 305 - RNA, 23 nt, Homo sapiens
gcguccgcaaguguaagaagugc

SEQ ID NO: 306 - RNA, 23 nt, Homo sapiens
cguccgcaaguguaagaagugcg

SEQ ID NO: 307 - RNA, 23 nt, Homo sapiens
guccgcaaguguaagaagugcga

SEQ ID NO: 308 - RNA, 23 nt, Homo sapiens
uccgcaaguguaagaagugcgaa

SEQ ID NO: 309 - RNA, 23 nt, Homo sapiens
ccgcaaguguaagaagugcgaag

SEQ ID NO: 310 - RNA, 23 nt, Homo sapiens
gcaaguguaagaagugcgaaggg

SEQ ID NO: 311 - RNA, 23 nt, Homo sapiens
caaguguaagaagugcgaagggc

SEQ ID NO: 312 - RNA, 23 nt, Homo sapiens
aaguguaagaagugcgaagggcc

SEQ ID NO: 313 - RNA, 23 nt, Homo sapiens
aguguaagaagugcgaagggccu

SEQ ID NO: 314 - RNA, 23 nt, Homo sapiens
guguaagaagugcgaagggccuu

SEQ ID NO: 315 - RNA, 23 nt, Homo sapiens
uguaagaagugcgaagggccuug

SEQ ID NO: 316 - RNA, 23 nt, Homo sapiens
guaagaagugcgaagggccuugc

SEQ ID NO: 317 - RNA, 23 nt, Homo sapiens
uaagaagugcgaagggccuugcc

SEQ ID NO: 318 - RNA, 23 nt, Homo sapiens
gaagugcgaagggccuugccgca

SEQ ID NO: 319 - RNA, 23 nt, Homo sapiens
aagugcgaagggccuugccgcaa

SEQ ID NO: 320 - RNA, 23 nt, Homo sapiens
agugcgaagggccuugccgcaaa

SEQ ID NO: 321 - RNA, 23 nt, Homo sapiens
gugcgaagggccuugccgcaaag

SEQ ID NO: 322 - RNA, 23 nt, Homo sapiens
ugcgaagggccuugccgcaaagu

SEQ ID NO: 323 - RNA, 23 nt, Homo sapiens
cgaagggccuugccgcaaagugu

SEQ ID NO: 324 - RNA, 23 nt, Homo sapiens
gaagggccuugccgcaaagugug

SEQ ID NO: 325 - RNA, 23 nt, Homo sapiens
aagggccuugccgcaaagugugu

SEQ ID NO: 326 - RNA, 23 nt, Homo sapiens
agggccuugccgcaaagugugua

SEQ ID NO: 327 - RNA, 23 nt, Homo sapiens
gggccuugccgcaaaguguguaa

SEQ ID NO: 328 - RNA, 23 nt, Homo sapiens
gccuugccgcaaaguguguaacg

SEQ ID NO: 329 - RNA, 23 nt, Homo sapiens
acggaauagguauuggugaauuu

SEQ ID NO: 330 - RNA, 23 nt, Homo sapiens
cggaauagguauuggugaauuua

SEQ ID NO: 331 - RNA, 23 nt, Homo sapiens
ggaauagguauuggugaauuuaa

SEQ ID NO: 332 - RNA, 23 nt, Homo sapiens
gaauagguauuggugaauuuaaa

SEQ ID NO: 333 - RNA, 23 nt, Homo sapiens
auagguauuggugaauuuaaaga

SEQ ID NO: 334 - RNA, 23 nt, Homo sapiens
uagguauuggugaauuuaaagac

SEQ ID NO: 335 - RNA, 23 nt, Homo sapiens
cucacucuccauaaaugcuacga

SEQ ID NO: 336 - RNA, 23 nt, Homo sapiens
uauuaaacacuucaaaaacugca

SEQ ID NO: 337 - RNA, 23 nt, Homo sapiens
cacuucaaaaacugcaccuccau

SEQ ID NO: 338 - RNA, 23 nt, Homo sapiens
acuucaaaaacugcaccuccauc

SEQ ID NO: 339 - RNA, 23 nt, Homo sapiens
cuucaaaaacugcaccuccauca

SEQ ID NO: 340 - RNA, 23 nt, Homo sapiens
uucaaaaacugcaccuccaucag

SEQ ID NO: 341 - RNA, 23 nt, Homo sapiens
ucaaaaacugcaccuccaucagu

SEQ ID NO: 342 - RNA, 23 nt, Homo sapiens
aaacugcaccuccaucaguggcg

SEQ ID NO: 343 - RNA, 23 nt, Homo sapiens
ugcaccuccaucaguggcgaucu

SEQ ID NO: 344 - RNA, 23 nt, Homo sapiens
gcaccuccaucaguggcgaucuc

SEQ ID NO: 345 - RNA, 23 nt, Homo sapiens
accuccaucaguggcgaucucca

SEQ ID NO: 346 - RNA, 23 nt, Homo sapiens
uccaucaguggcgaucuccacau

SEQ ID NO: 347 - RNA, 23 nt, Homo sapiens
aguggcgaucuccacauccugcc

SEQ ID NO: 348 - RNA, 23 nt, Homo sapiens
guggcgaucuccacauccugccg

SEQ ID NO: 349 - RNA, 23 nt, Homo sapiens
uggcgaucuccacauccugccgg

SEQ ID NO: 350 - RNA, 23 nt, Homo sapiens
ggcgaucuccacauccugccggu

SEQ ID NO: 351 - RNA, 23 nt, Homo sapiens
gcgaucuccacauccugccggug

SEQ ID NO: 352 - RNA, 23 nt, Homo sapiens
cuccacauccugccgguggcauu

SEQ ID NO: 353 - RNA, 23 nt, Homo sapiens
uccacauccugccgguggcauuu

SEQ ID NO: 354 - RNA, 23 nt, Homo sapiens
ccacauccugccgguggcauuua

SEQ ID NO: 355 - RNA, 23 nt, Homo sapiens
acauccugccgguggcauuuagg

SEQ ID NO: 356 - RNA, 23 nt, Homo sapiens
uccugccgguggcauuuaggggu

SEQ ID NO: 357 - RNA, 23 nt, Homo sapiens
ccugccgguggcauuuaggggug

SEQ ID NO: 358 - RNA, 23 nt, Homo sapiens
cugccgguggcauuuagggguga

SEQ ID NO: 359 - RNA, 23 nt, Homo sapiens
ugccgguggcauuuaggggugac

SEQ ID NO: 360 - RNA, 23 nt, Homo sapiens
cgguggcauuuaggggugacucc

SEQ ID NO: 361 - RNA, 23 nt, Homo sapiens
uggcauuuaggggugacuccuuc

SEQ ID NO: 362 - RNA, 23 nt, Homo sapiens
ggcauuuaggggugacuccuuca

SEQ ID NO: 363 - RNA, 23 nt, Homo sapiens
gcauuuaggggugacuccuucac

SEQ ID NO: 364 - RNA, 23 nt, Homo sapiens
cauuuaggggugacuccuucaca

SEQ ID NO: 365 - RNA, 23 nt, Homo sapiens
auuuaggggugacuccuucacac

SEQ ID NO: 366 - RNA, 23 nt, Homo sapiens
uuuaggggugacuccuucacaca

SEQ ID NO: 367 - RNA, 23 nt, Homo sapiens
ccucuggauccacaggaacugga

SEQ ID NO: 368 - RNA, 23 nt, Homo sapiens
uggauccacaggaacuggauauu

SEQ ID NO: 369 - RNA, 23 nt, Homo sapiens
ggauccacaggaacuggauauuc

SEQ ID NO: 370 - RNA, 23 nt, Homo sapiens
auccacaggaacuggauauucug

SEQ ID NO: 371 - RNA, 23 nt, Homo sapiens
uccacaggaacuggauauucuga

SEQ ID NO: 372 - RNA, 23 nt, Homo sapiens
gaacuggauauucugaaaaccgu

SEQ ID NO: 373 - RNA, 23 nt, Homo sapiens
auauucugaaaaccguaaaggaa

SEQ ID NO: 374 - RNA, 23 nt, Homo sapiens
uauucugaaaaccguaaaggaaa

SEQ ID NO: 375 - RNA, 23 nt, Homo sapiens
ucugaaaaccguaaaggaaauca

SEQ ID NO: 376 - RNA, 23 nt, Homo sapiens
cugaaaaccguaaaggaaaucac

SEQ ID NO: 377 - DNA, 21 bp, Artificial Sequence
  Description of Artificial Sequence: Synthetic oligonucleotide
  Description of Combined DNA/RNA Molecule: Synthetic oligonucleotide
cggccggagucccgagcuatt

SEQ ID NO: 378 - DNA, 21 bp, Artificial Sequence
  Description of Artificial Sequence: Synthetic oligonucleotide
  Description of Combined DNA/RNA Molecule: Synthetic oligonucleotide
uagcucgggacuccggccgtt

SEQ ID NO: 379 - DNA, 21 bp, Artificial Sequence
  Description of Artificial Sequence: Synthetic oligonucleotide
  Description of Combined DNA/RNA Molecule: Synthetic oligonucleotide
ccggagucccgagcuagcctt

SEQ ID NO: 380 - DNA, 21 bp, Artificial Sequence
  Description of Artificial Sequence: Synthetic oligonucleotide
  Description of Combined DNA/RNA Molecule: Synthetic oligonucleotide
ggcuagcucgggacuccggtt

SEQ ID NO: 381 - DNA, 21 bp, Artificial Sequence
  Description of Artificial Sequence: Synthetic oligonucleotide
  Description of Combined DNA/RNA Molecule: Synthetic oligonucleotide
cggagucccgagcuagccctt

SEQ ID NO: 382 - DNA, 21 bp, Artificial Sequence
  Description of Artificial Sequence: Synthetic oligonucleotide
  Description of Combined DNA/RNA Molecule: Synthetic oligonucleotide
gggcuagcucgggacuccgtt

SEQ ID NO: 383 - DNA, 21 bp, Artificial Sequence
  Description of Artificial Sequence: Synthetic oligonucleotide
  Description of Combined DNA/RNA Molecule: Synthetic oligonucleotide
ggagucccgagcuagcccctt

SEQ ID NO: 384 - DNA, 21 bp, Artificial Sequence
  Description of Artificial Sequence: Synthetic oligonucleotide
  Description of Combined DNA/RNA Molecule: Synthetic oligonucleotide
ggggcuagcucgggacucctt

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
gagucccgagcuagccccgtt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
cggggcuagcucgggacuctt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
agucccgagcuagccccggtt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
ccggggcuagcucgggacutt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
gucccgagcuagccccggctt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
gccggggcuagcucgggactt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
cccgagcuagccccggcggtt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
ccgccggggcuagcucgggtt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
ggacgacaggccaccucgutt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
acgagguggccugucgucctt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
gacgacaggccaccucguctt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
gacgagguggccugucguctt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
acgacaggccaccucgucgtt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
cgacgagguggccugucgutt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
cgacaggccaccucgucggtt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
ccgacgagguggccugucgtt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
gacaggccaccucgucggctt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
gccgacgagguggccuguctt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
caggccaccucgucggcgutt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
acgccgacgagguggccugtt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
aggccaccucgucggcguctt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
gacgccgacgagguggccutt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
ggccaccucgucggcgucctt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
ggacgccgacgagguggcctt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
gccaccucgucggcguccgtt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
cggacgccgacgagguggctt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
ccaccucgucggcguccgctt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
gcggacgccgacgagguggtt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
caccucgucggcguccgcctt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
ggcggacgccgacgaggugtt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
accucgucggcguccgccctt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
gggcggacgccgacgaggutt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
ccucgucggcguccgcccgtt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
cgggcggacgccgacgaggtt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
cucgucggcguccgcccgatt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
ucgggcggacgccgacgagtt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
ucgucggcguccgcccgagtt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
cucgggcggacgccgacgatt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
cgucggcguccgcccgagutt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
acucgggcggacgccgacgtt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
gucggcguccgcccgaguctt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
gacucgggcggacgccgactt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
ucggcguccgcccgagucctt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
ggacucgggcggacgccgatt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
gcguccgcccgaguccccgtt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
cggggacucgggcggacgctt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
cguccgcccgaguccccgctt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
gcggggacucgggcggacgtt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
gcccgaguccccgccucgctt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
gcgaggcggggacucgggctt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
aacgccacaaccaccgcgctt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
gcgcggugguuguggcguutt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
acgccacaaccaccgcgcatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
ugcgcggugguuguggcgutt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
cgccacaaccaccgcgcactt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
gugcgcggugguuguggcgtt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
ccacaaccaccgcgcacggtt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
ccgugcgcggugguuguggtt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
cacaaccaccgcgcacggctt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
gccgugcgcggugguugugtt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
acaaccaccgcgcacggcctt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
ggccgugcgcggugguugutt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
augcgacccuccgggacggtt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
ccgucccggagggucgcautt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
ugcgacccuccgggacggctt

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
gccgucccggagggucgcatt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
gcgacccuccgggacggcctt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
ggccgucccggagggucgctt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
gacccuccgggacggccggtt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
ccggccgucccggaggguctt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
acccuccgggacggccgggtt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
cccggccgucccggagggutt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
ccuccgggacggccggggctt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
gccccggccgucccggaggtt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
agaaaguuugccaaggcactt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
gugccuuggcaaacuuucutt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
gaaaguuugccaaggcacgtt

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
cgugccuuggcaaacuuuctt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
aaguuugccaaggcacgagtt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
cucgugccuuggcaaacuutt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
aguuugccaaggcacgagutt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
guuugccaaggcacgaguatt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
uacucgugccuuggcaaactt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
uuugccaaggcacgaguaatt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
uuacucgugccuuggcaaatt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
uugccaaggcacgaguaactt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
guuacucgugccuuggcaatt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
ugccaaggcacgaguaacatt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
uguuacucgugccuuggcatt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
gccaaggcacgaguaacaatt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
uuguuacucgugccuuggctt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
acgcaguugggcacuuuugtt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
caaaagugcccaacugcgutt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
cgcaguugggcacuuuugatt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
ucaaaagugcccaacugcgtt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
gcaguugggcacuuuugaatt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
uucaaaagugcccaacugctt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
caguugggcacuuuugaagtt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
cuucaaaagugcccaacugtt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
aguugggcacuuuugaagatt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
ucuucaaaagugcccaacutt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
guugggcacuuuugaagautt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
aucuucaaaagugcccaactt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
uugggcacuuuugaagauctt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
gaucuucaaaagugcccaatt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
ugggcacuuuugaagaucatt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
ugaucuucaaaagugcccatt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
gggcacuuuugaagaucautt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
augaucuucaaaagugccctt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
uugaagaucauuuucucagtt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
cugagaaaaugaucuucaatt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
gaagaucauuuucucagcctt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
ggcugagaaaaugaucuuctt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
aagaucauuuucucagccutt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
aggcugagaaaaugaucuutt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
cauuuucucagccuccagatt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
ucuggaggcugagaaaaugtt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
agccuccagaggauguucatt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
ugaacauccucuggaggcutt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
ccuccagaggauguucaautt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
auugaacauccucuggaggtt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
cuccagaggauguucaauatt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
uauugaacauccucuggagtt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
agaggauguucaauaacugtt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
caguuauugaacauccucutt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
aggauguucaauaacugugtt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
cacaguuauugaacauccutt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
uguucaauaacugugaggutt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
accucacaguuauugaacatt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
uucaauaacugugagguggtt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
ccaccucacaguuauugaatt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
ucaauaacugugagguggutt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
accaccucacaguuauugatt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
caauaacugugaggugguctt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
gaccaccucacaguuauugtt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
aauaacugugagguggucctt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
ggaccaccucacaguuauutt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
auaacugugaggugguccutt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
aggaccaccucacaguuautt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
uaacugugaggugguccuutt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
aaggaccaccucacaguuatt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
acugugaggugguccuuggtt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
ccaaggaccaccucacagutt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
ugugaggugguccuugggatt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
ucccaaggaccaccucacatt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
gugaggugguccuugggaatt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
uucccaaggaccaccucactt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
ugguccuugggaauuuggatt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
uccaaauucccaaggaccatt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
uugggaauuuggaaauuactt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
guaauuuccaaauucccaatt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
ugggaauuuggaaauuacctt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
gguaauuuccaaauucccatt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
gggaauuuggaaauuaccutt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
agguaauuuccaaauuccctt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
ggaauuuggaaauuaccuatt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
uagguaauuuccaaauucctt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
agaggaauuaugaucuuuctt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
gaaagaucauaauuccucutt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
gaggaauuaugaucuuucctt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
ggaaagaucauaauuccuctt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
aauuaugaucuuuccuucutt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
agaaggaaagaucauaauutt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
auuaugaucuuuccuucuutt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
aagaaggaaagaucauaautt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
uaugaucuuuccuucuuaatt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
uuaagaaggaaagaucauatt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
ugaucuuuccuucuuaaagtt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
cuuuaagaaggaaagaucatt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
ucuuuccuucuuaaagacctt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
ggucuuuaagaaggaaagatt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
ccuucuuaaagaccauccatt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
uggauggucuuuaagaaggtt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
cuucuuaaagaccauccagtt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
cuggauggucuuuaagaagtt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
ucuuaaagaccauccaggatt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
uccuggauggucuuuaagatt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
uuaaagaccauccaggaggtt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
ccuccuggauggucuuuaatt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
uaaagaccauccaggaggutt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
accuccuggauggucuuuatt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
ccaggagguggcugguuautt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
auaaccagccaccuccuggtt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
caggagguggcugguuaugtt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
cauaaccagccaccuccugtt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
aggagguggcugguuaugutt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
acauaaccagccaccuccutt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
ggagguggcugguuauguctt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
gacauaaccagccaccucctt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
gagguggcugguuaugucctt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
ggacauaaccagccaccuctt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
agguggcugguuauguccutt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
aggacauaaccagccaccutt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
guggcugguuauguccucatt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
ugaggacauaaccagccactt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
gcccucaacacaguggagctt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
gcuccacuguguugagggctt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
uuccuuuggaaaaccugcatt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
ugcagguuuuccaaaggaatt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
uccuuuggaaaaccugcagtt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
cugcagguuuuccaaaggatt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
gaaaaccugcagaucaucatt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
ugaugaucugcagguuuuctt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
aaaaccugcagaucaucagtt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
cugaugaucugcagguuuutt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
aaccugcagaucaucagagtt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
cucugaugaucugcagguutt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
cugcagaucaucagaggaatt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
uuccucugaugaucugcagtt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
gaaaauuccuaugccuuagtt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
cuaaggcauaggaauuuuctt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
aaaauuccuaugccuuagctt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
gcuaaggcauaggaauuuutt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
aauuccuaugccuuagcagtt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
cugcuaaggcauaggaauutt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
uccuaugccuuagcagucutt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
agacugcuaaggcauaggatt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
ccuaugccuuagcagucuutt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
aagacugcuaaggcauaggtt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
cuaugccuuagcagucuuatt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
uaagacugcuaaggcauagtt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
augccuuagcagucuuauctt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
gauaagacugcuaaggcautt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
ugccuuagcagucuuaucutt

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
agauaagacugcuaaggcatt

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
gccuuagcagucuuaucuatt

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
uagauaagacugcuaaggctt

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
ccuuagcagucuuaucuaatt

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
uuagauaagacugcuaaggtt

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
cuuagcagucuuaucuaactt

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
guuagauaagacugcuaagtt

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
uuagcagucuuaucuaacutt

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
aguuagauaagacugcuaatt

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
uagcagucuuaucuaacuatt

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
uaguuagauaagacugcuatt

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
agcagucuuaucuaacuautt

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
auaguuagauaagacugcutt

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
gcagucuuaucuaacuaugtt

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
cauaguuagauaagacugctt

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
cagucuuaucuaacuaugatt

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
ucauaguuagauaagacugtt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
ucuuaucuaacuaugaugctt

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
gcaucauaguuagauaagatt

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
cuuaucuaacuaugaugcatt

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
ugcaucauaguuagauaagtt

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
uuaucuaacuaugaugcaatt

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
uugcaucauaguuagauaatt

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
uaucuaacuaugaugcaaatt

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
uuugcaucauaguuagauatt

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
aucuaacuaugaugcaaautt

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
auuugcaucauaguuagautt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
ucuaacuaugaugcaaauatt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
uauuugcaucauaguuagatt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
cuaacuaugaugcaaauaatt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
uuauuugcaucauaguuagtt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
aacuaugaugcaaauaaaatt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
uuuuauuugcaucauaguutt

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
gaugcaaauaaaaccggactt

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
guccgguuuuauuugcauctt

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
augcaaauaaaaccggacutt

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
aguccgguuuuauuugcautt

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
ugcaaauaaaaccggacugtt

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
caguccgguuuuauuugcatt

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
caaauaaaaccggacugaatt

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
uucaguccgguuuuauuugtt

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
aaauaaaaccggacugaagtt

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
cuucaguccgguuuuauuutt

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
aauaaaaccggacugaaggtt

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
ccuucaguccgguuuuauutt

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
uaaaaccggacugaaggagtt

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
cuccuucaguccgguuuuatt

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
aaaaccggacugaaggagctt

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
gcuccuucaguccgguuuutt

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
aaaccggacugaaggagcutt

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
agcuccuucaguccgguuutt

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
aaccggacugaaggagcugtt

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
cagcuccuucaguccgguutt

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
aggagcugcccaugagaaatt

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
uuucucaugggcagcuccutt

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
uacaggaaauccugcauggtt

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
ccaugcaggauuuccuguatt

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
aggaaauccugcauggcgctt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
gcgccaugcaggauuuccutt

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
ggaaauccugcauggcgcctt

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
ggcgccaugcaggauuucctt

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
gaaauccugcauggcgccgtt

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
cggcgccaugcaggauuuctt

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
aaauccugcauggcgccgutt

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
acggcgccaugcaggauuutt

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
aauccugcauggcgccgugtt

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
cacggcgccaugcaggauutt

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
uccugcauggcgccgugcgtt

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
cgcacggcgccaugcaggatt

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
cugcauggcgccgugcggutt

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
accgcacggcgccaugcagtt

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
ugcauggcgccgugcgguutt

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
aaccgcacggcgccaugcatt

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
gcauggcgccgugcgguuctt

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
gaaccgcacggcgccaugctt

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
auggcgccgugcgguucagtt

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
cugaaccgcacggcgccautt

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
uggcgccgugcgguucagctt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
gcugaaccgcacggcgccatt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
ggcgccgugcgguucagcatt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
ugcugaaccgcacggcgcctt

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
gcgccgugcgguucagcaatt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
uugcugaaccgcacggcgctt

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
cgccgugcgguucagcaactt

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
guugcugaaccgcacggcgtt

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
gccgugcgguucagcaacatt

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
uguugcugaaccgcacggctt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
ccgugcgguucagcaacaatt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
uuguugcugaaccgcacggtt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
gugcgguucagcaacaacctt

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
gguuguugcugaaccgcactt

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
gcgguucagcaacaacccutt

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
aggguuguugcugaaccgctt

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
gguucagcaacaacccugctt

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
gcaggguuguugcugaacctt

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
gcaacaacccugcccugugtt

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
cacagggcaggguuguugctt

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
aacaacccugcccugugcatt

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
ugcacagggcaggguuguutt

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
acguggagagcauccagugtt

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
cacuggaugcucuccacgutt

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
cguggagagcauccaguggtt

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
ccacuggaugcucuccacgtt

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
guggagagcauccaguggctt

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
gccacuggaugcucuccactt

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
gagagcauccaguggcgggtt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
cccgccacuggaugcucuctt

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
agagcauccaguggcgggatt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
ucccgccacuggaugcucutt

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
gagcauccaguggcgggactt

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
gucccgccacuggaugcuctt

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
caguggcgggacauagucatt

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
ugacuaugucccgccacugtt

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
aguggcgggacauagucagtt

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
cugacuaugucccgccacutt

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
uggcgggacauagucagcatt

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
ugcugacuaugucccgccatt

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
ggcgggacauagucagcagtt

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
cugcugacuaugucccgcctt

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
cucagcaacaugucgauggtt

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
ccaucgacauguugcugagtt

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
cagcaacaugucgauggactt

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
guccaucgacauguugcugtt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
agcaacaugucgauggacutt

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
aguccaucgacauguugcutt

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
gcaacaugucgauggacuutt

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
aaguccaucgacauguugctt

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
aacaugucgauggacuucctt

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
ggaaguccaucgacauguutt

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
acaugucgauggacuuccatt

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
uggaaguccaucgacaugutt

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
caugucgauggacuuccagtt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
cuggaaguccaucgacaugtt

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
augucgauggacuuccagatt

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
ucuggaaguccaucgacautt

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
ucgauggacuuccagaacctt

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
gguucuggaaguccaucgatt

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
gaaccaccugggcagcugctt

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
gcagcugcccaggugguuctt

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
gggcagcugccaaaagugutt

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
acacuuuuggcagcugccctt

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
gcagcugccaaaagugugatt

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
ucacacuuuuggcagcugctt

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
ugccaaaagugugauccaatt

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
uuggaucacacuuuuggcatt

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
gccaaaagugugauccaagtt

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
cuuggaucacacuuuuggctt

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
ccaaaagugugauccaagctt

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
gcuuggaucacacuuuuggtt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
aaagugugauccaagcugutt

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
acagcuuggaucacacuuutt

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
ugugauccaagcugucccatt

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
ugggacagcuuggaucacatt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
gugauccaagcugucccaatt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
uugggacagcuuggaucactt

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
gauccaagcugucccaaugtt

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
cauugggacagcuuggauctt

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
auccaagcugucccaauggtt

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
ccauugggacagcuuggautt

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
uccaagcugucccaaugggtt

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
cccauugggacagcuuggatt

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
ccaagcugucccaaugggatt

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
ucccauugggacagcuuggtt

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
caagcugucccaaugggagtt

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
cucccauugggacagcuugtt

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
agcugucccaaugggagcutt

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
agcucccauugggacagcutt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
ugucccaaugggagcugcutt

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
agcagcucccauugggacatt

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
ggugcaggagaggagaacutt

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
aguucuccucuccugcacctt

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
aaacugaccaaaaucaucutt

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
agaugauuuuggucaguuutt

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
aacugaccaaaaucaucugtt

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
cagaugauuuuggucaguutt

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
acugaccaaaaucaucugutt

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
acagaugauuuuggucagutt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
accaaaaucaucugugccctt

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
gggcacagaugauuuuggutt

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
ccaaaaucaucugugcccatt

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
ugggcacagaugauuuuggtt

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
aaaucaucugugcccagcatt

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
ugcugggcacagaugauuutt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
gugcccagcagugcuccggtt

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
ccggagcacugcugggcactt

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
gcccagcagugcuccgggctt

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
gcccggagcacugcugggctt

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
ccagugacugcugccacaatt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
uuguggcagcagucacuggtt

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
cagugacugcugccacaactt

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
guuguggcagcagucacugtt

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
gagagcgacugccuggucutt

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
agaccaggcagucgcucuctt

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
agagcgacugccuggucugtt

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
cagaccaggcagucgcucutt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
gagcgacugccuggucugctt

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
gcagaccaggcagucgcuctt

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
agcgacugccuggucugcctt

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
ggcagaccaggcagucgcutt

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
gcgacugccuggucugccgtt

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
cggcagaccaggcagucgctt

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
cgacugccuggucugccgctt

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
gcggcagaccaggcagucgtt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
gccuggucugccgcaaauutt

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
aauuugcggcagaccaggctt

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
ccuggucugccgcaaauuctt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
gaauuugcggcagaccaggtt

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
cuggucugccgcaaauucctt

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
ggaauuugcggcagaccagtt

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
uggucugccgcaaauuccgtt

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
cggaauuugcggcagaccatt

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
gucugccgcaaauuccgagtt

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
cucggaauuugcggcagactt

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
ucugccgcaaauuccgagatt

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
ucucggaauuugcggcagatt

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
cugccgcaaauuccgagactt

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
gucucggaauuugcggcagtt

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
ugccgcaaauuccgagacgtt

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
cgucucggaauuugcggcatt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
ccgcaaauuccgagacgaatt

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
uucgucucggaauuugcggtt

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
aauuccgagacgaagccactt

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
guggcuucgucucggaauutt

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
auuccgagacgaagccacgtt

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
cguggcuucgucucggaautt

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
uuccgagacgaagccacgutt

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
acguggcuucgucucggaatt

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
uccgagacgaagccacgugtt

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
cacguggcuucgucucggatt

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
ccgagacgaagccacgugctt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
gcacguggcuucgucucggtt

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
gagacgaagccacgugcaatt

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
uugcacguggcuucgucuctt

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
acgaagccacgugcaaggatt

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
uccuugcacguggcuucgutt

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
cgaagccacgugcaaggactt

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
guccuugcacguggcuucgtt

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
gaagccacgugcaaggacatt

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
uguccuugcacguggcuuctt

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
aagccacgugcaaggacactt

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
guguccuugcacguggcuutt

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
ccccacucaugcucuacaatt

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
uuguagagcaugaguggggtt

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
ccacucaugcucuacaacctt

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
gguuguagagcaugaguggtt

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
acucaugcucuacaacccctt

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
gggguuguagagcaugagutt

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
caugcucuacaaccccacctt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
ggugggguuguagagcaugtt

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
ccagauggaugugaacccctt

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
gggguucacauccaucuggtt

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
agauggaugugaaccccgatt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
ucgggguucacauccaucutt

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
gauggaugugaaccccgagtt

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
cucgggguucacauccauctt

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
auggaugugaaccccgaggtt

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
ccucgggguucacauccautt

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
ggaugugaaccccgagggctt

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
gcccucgggguucacaucctt

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
gaugugaaccccgagggcatt

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
ugcccucgggguucacauctt

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
ugugaaccccgagggcaaatt

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
uuugcccucgggguucacatt

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
aaccccgagggcaaauacatt

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
uguauuugcccucgggguutt

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
accccgagggcaaauacagtt

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
cuguauuugcccucggggutt

SEQ ID NO: 877 - DNA, 21 bp, Artificial Sequence
  Description of Artificial Sequence: Synthetic oligonucleotide
  Description of Combined DNA/RNA Molecule: Synthetic oligonucleotide
cccgagggcaaauacagcutt

SEQ ID NO: 878 - DNA, 21 bp, Artificial Sequence
  Description of Artificial Sequence: Synthetic oligonucleotide
  Description of Combined DNA/RNA Molecule: Synthetic oligonucleotide
agcuguauuugcccucgggtt

SEQ ID NO: 879 - DNA, 21 bp, Artificial Sequence
  Description of Artificial Sequence: Synthetic oligonucleotide
  Description of Combined DNA/RNA Molecule: Synthetic oligonucleotide
ccgagggcaaauacagcuutt

SEQ ID NO: 880 - DNA, 21 bp, Artificial Sequence
  Description of Artificial Sequence: Synthetic oligonucleotide
  Description of Combined DNA/RNA Molecule: Synthetic oligonucleotide
aagcuguauuugcccucggtt

SEQ ID NO: 881 - DNA, 21 bp, Artificial Sequence
  Description of Artificial Sequence: Synthetic oligonucleotide
  Description of Combined DNA/RNA Molecule: Synthetic oligonucleotide
cgagggcaaauacagcuuutt

SEQ ID NO: 882 - DNA, 21 bp, Artificial Sequence
  Description of Artificial Sequence: Synthetic oligonucleotide
  Description of Combined DNA/RNA Molecule: Synthetic oligonucleotide
aaagcuguauuugcccucgtt

SEQ ID NO: 883 - DNA, 21 bp, Artificial Sequence
  Description of Artificial Sequence: Synthetic oligonucleotide
  Description of Combined DNA/RNA Molecule: Synthetic oligonucleotide
aaauacagcuuuggugccatt

SEQ ID NO: 884 - DNA, 21 bp, Artificial Sequence
  Description of Artificial Sequence: Synthetic oligonucleotide
  Description of Combined DNA/RNA Molecule: Synthetic oligonucleotide
uggcaccaaagcuguauuutt

SEQ ID NO: 885 - DNA, 21 bp, Artificial Sequence
  Description of Artificial Sequence: Synthetic oligonucleotide
  Description of Combined DNA/RNA Molecule: Synthetic oligonucleotide
aauacagcuuuggugccactt

SEQ ID NO: 886 - DNA, 21 bp, Artificial Sequence
  Description of Artificial Sequence: Synthetic oligonucleotide
  Description of Combined DNA/RNA Molecule: Synthetic oligonucleotide
guggcaccaaagcuguauutt

SEQ ID NO: 887 - DNA, 21 bp, Artificial Sequence
  Description of Artificial Sequence: Synthetic oligonucleotide
  Description of Combined DNA/RNA Molecule: Synthetic oligonucleotide
auacagcuuuggugccacctt

SEQ ID NO: 888 - DNA, 21 bp, Artificial Sequence
  Description of Artificial Sequence: Synthetic oligonucleotide
  Description of Combined DNA/RNA Molecule: Synthetic oligonucleotide
gguggcaccaaagcuguautt

SEQ ID NO: 889 - DNA, 21 bp, Artificial Sequence
  Description of Artificial Sequence: Synthetic oligonucleotide
  Description of Combined DNA/RNA Molecule: Synthetic oligonucleotide
cuuuggugccaccugcgugtt

SEQ ID NO: 890 - DNA, 21 bp, Artificial Sequence
  Description of Artificial Sequence: Synthetic oligonucleotide
  Description of Combined DNA/RNA Molecule: Synthetic oligonucleotide
cacgcagguggcaccaaagtt

SEQ ID NO: 891 - DNA, 21 bp, Artificial Sequence
  Description of Artificial Sequence: Synthetic oligonucleotide
  Description of Combined DNA/RNA Molecule: Synthetic oligonucleotide
uuggugccaccugcgugaatt

SEQ ID NO: 892 - DNA, 21 bp, Artificial Sequence
  Description of Artificial Sequence: Synthetic oligonucleotide
  Description of Combined DNA/RNA Molecule: Synthetic oligonucleotide
uucacgcagguggcaccaatt

SEQ ID NO: 893 - DNA, 21 bp, Artificial Sequence
  Description of Artificial Sequence: Synthetic oligonucleotide
  Description of Combined DNA/RNA Molecule: Synthetic oligonucleotide
ccaccugcgugaagaagugtt

SEQ ID NO: 894 - DNA, 21 bp, Artificial Sequence
  Description of Artificial Sequence: Synthetic oligonucleotide
  Description of Combined DNA/RNA Molecule: Synthetic oligonucleotide
cacuucuucacgcagguggtt

SEQ ID NO: 895 - DNA, 21 bp, Artificial Sequence
  Description of Artificial Sequence: Synthetic oligonucleotide
  Description of Combined DNA/RNA Molecule: Synthetic oligonucleotide
cugcgugaagaaguguccctt

SEQ ID NO: 896 - DNA, 21 bp, Artificial Sequence
  Description of Artificial Sequence: Synthetic oligonucleotide
  Description of Combined DNA/RNA Molecule: Synthetic oligonucleotide
gggacacuucuucacgcagtt

SEQ ID NO: 897 - DNA, 21 bp, Artificial Sequence
  Description of Artificial Sequence: Synthetic oligonucleotide
  Description of Combined DNA/RNA Molecule: Synthetic oligonucleotide
ugcgugaagaagugucccctt

SEQ ID NO: 898 - DNA, 21 bp, Artificial Sequence
  Description of Artificial Sequence: Synthetic oligonucleotide
  Description of Combined DNA/RNA Molecule: Synthetic oligonucleotide
ggggacacuucuucacgcatt

SEQ ID NO: 899 - DNA, 21 bp, Artificial Sequence
  Description of Artificial Sequence: Synthetic oligonucleotide
  Description of Combined DNA/RNA Molecule: Synthetic oligonucleotide
gcgugaagaaguguccccgtt

SEQ ID NO: 900 - DNA, 21 bp, Artificial Sequence
  Description of Artificial Sequence: Synthetic oligonucleotide
  Description of Combined DNA/RNA Molecule: Synthetic oligonucleotide
cggggacacuucuucacgctt

SEQ ID NO: 901 - DNA, 21 bp, Artificial Sequence
  Description of Artificial Sequence: Synthetic oligonucleotide
  Description of Combined DNA/RNA Molecule: Synthetic oligonucleotide
cgugaagaaguguccccgutt

SEQ ID NO: 902 - DNA, 21 bp, Artificial Sequence
  Description of Artificial Sequence: Synthetic oligonucleotide
  Description of Combined DNA/RNA Molecule: Synthetic oligonucleotide
acggggacacuucuucacgtt

SEQ ID NO: 903 - DNA, 21 bp, Artificial Sequence
  Description of Artificial Sequence: Synthetic oligonucleotide
  Description of Combined DNA/RNA Molecule: Synthetic oligonucleotide
gugaagaaguguccccguatt

SEQ ID NO: 904 - DNA, 21 bp, Artificial Sequence
  Description of Artificial Sequence: Synthetic oligonucleotide
  Description of Combined DNA/RNA Molecule: Synthetic oligonucleotide
uacggggacacuucuucactt

SEQ ID NO: 905 - DNA, 21 bp, Artificial Sequence
  Description of Artificial Sequence: Synthetic oligonucleotide
  Description of Combined DNA/RNA Molecule: Synthetic oligonucleotide
ugaagaaguguccccguaatt

SEQ ID NO: 906 - DNA, 21 bp, Artificial Sequence
  Description of Artificial Sequence: Synthetic oligonucleotide
  Description of Combined DNA/RNA Molecule: Synthetic oligonucleotide
uuacggggacacuucuucatt

SEQ ID NO: 907 - DNA, 21 bp, Artificial Sequence
  Description of Artificial Sequence: Synthetic oligonucleotide
  Description of Combined DNA/RNA Molecule: Synthetic oligonucleotide
gaagaaguguccccguaautt

SEQ ID NO: 908 - DNA, 21 bp, Artificial Sequence
  Description of Artificial Sequence: Synthetic oligonucleotide
  Description of Combined DNA/RNA Molecule: Synthetic oligonucleotide
auuacggggacacuucuuctt

SEQ ID NO: 909 - DNA, 21 bp, Artificial Sequence
  Description of Artificial Sequence: Synthetic oligonucleotide
  Description of Combined DNA/RNA Molecule: Synthetic oligonucleotide
aagaaguguccccguaauutt

SEQ ID NO: 910 - DNA, 21 bp, Artificial Sequence
  Description of Artificial Sequence: Synthetic oligonucleotide
  Description of Combined DNA/RNA Molecule: Synthetic oligonucleotide
aauuacggggacacuucuutt

SEQ ID NO: 911 - DNA, 21 bp, Artificial Sequence
  Description of Artificial Sequence: Synthetic oligonucleotide
  Description of Combined DNA/RNA Molecule: Synthetic oligonucleotide
agaaguguccccguaauuatt

SEQ ID NO: 912 - DNA, 21 bp, Artificial Sequence
  Description of Artificial Sequence: Synthetic oligonucleotide
  Description of Combined DNA/RNA Molecule: Synthetic oligonucleotide
uaauuacggggacacuucutt

SEQ ID NO: 913 - DNA, 21 bp, Artificial Sequence
  Description of Artificial Sequence: Synthetic oligonucleotide
  Description of Combined DNA/RNA Molecule: Synthetic oligonucleotide
gaaguguccccguaauuautt

SEQ ID NO: 914 - DNA, 21 bp, Artificial Sequence
  Description of Artificial Sequence: Synthetic oligonucleotide
  Description of Combined DNA/RNA Molecule: Synthetic oligonucleotide
auaauuacggggacacuuctt

SEQ ID NO: 915 - DNA, 21 bp, Artificial Sequence
  Description of Artificial Sequence: Synthetic oligonucleotide
  Description of Combined DNA/RNA Molecule: Synthetic oligonucleotide
aaguguccccguaauuaugtt

SEQ ID NO: 916 - DNA, 21 bp, Artificial Sequence
  Description of Artificial Sequence: Synthetic oligonucleotide
  Description of Combined DNA/RNA Molecule: Synthetic oligonucleotide
cauaauuacggggacacuutt

SEQ ID NO: 917 - DNA, 21 bp, Artificial Sequence
  Description of Artificial Sequence: Synthetic oligonucleotide
  Description of Combined DNA/RNA Molecule: Synthetic oligonucleotide
aguguccccguaauuaugutt

SEQ ID NO: 918 - DNA, 21 bp, Artificial Sequence
  Description of Artificial Sequence: Synthetic oligonucleotide
  Description of Combined DNA/RNA Molecule: Synthetic oligonucleotide
acauaauuacggggacacutt

SEQ ID NO: 919 - DNA, 21 bp, Artificial Sequence
  Description of Artificial Sequence: Synthetic oligonucleotide
  Description of Combined DNA/RNA Molecule: Synthetic oligonucleotide
guguccccguaauuaugugtt

SEQ ID NO: 920 - DNA, 21 bp, Artificial Sequence
  Description of Artificial Sequence: Synthetic oligonucleotide
  Description of Combined DNA/RNA Molecule: Synthetic oligonucleotide
cacauaauuacggggacactt

SEQ ID NO: 921 - DNA, 21 bp, Artificial Sequence
  Description of Artificial Sequence: Synthetic oligonucleotide
  Description of Combined DNA/RNA Molecule: Synthetic oligonucleotide
uguccccguaauuauguggtt

SEQ ID NO: 922 - DNA, 21 bp, Artificial Sequence
  Description of Artificial Sequence: Synthetic oligonucleotide
  Description of Combined DNA/RNA Molecule: Synthetic oligonucleotide
ccacauaauuacggggacatt

SEQ ID NO: 923 - DNA, 21 bp, Artificial Sequence
  Description of Artificial Sequence: Synthetic oligonucleotide
  Description of Combined DNA/RNA Molecule: Synthetic oligonucleotide
guccccguaauuauguggutt

SEQ ID NO: 924 - DNA, 21 bp, Artificial Sequence
  Description of Artificial Sequence: Synthetic oligonucleotide
  Description of Combined DNA/RNA Molecule: Synthetic oligonucleotide
accacauaauuacggggactt

SEQ ID NO: 925 - DNA, 21 bp, Artificial Sequence
  Description of Artificial Sequence: Synthetic oligonucleotide
  Description of Combined DNA/RNA Molecule: Synthetic oligonucleotide
ccccguaauuauguggugatt

SEQ ID NO: 926 - DNA, 21 bp, Artificial Sequence
  Description of Artificial Sequence: Synthetic oligonucleotide
  Description of Combined DNA/RNA Molecule: Synthetic oligonucleotide
ucaccacauaauuacggggtt

SEQ ID NO: 927 - DNA, 21 bp, Artificial Sequence
  Description of Artificial Sequence: Synthetic oligonucleotide
  Description of Combined DNA/RNA Molecule: Synthetic oligonucleotide
ccguaauuauguggugacatt

SEQ ID NO: 928 - DNA, 21 bp, Artificial Sequence
  Description of Artificial Sequence: Synthetic oligonucleotide
  Description of Combined DNA/RNA Molecule: Synthetic oligonucleotide
ugucaccacauaauuacggtt

SEQ ID NO: 929 - DNA, 21 bp, Artificial Sequence
  Description of Artificial Sequence: Synthetic oligonucleotide
  Description of Combined DNA/RNA Molecule: Synthetic oligonucleotide
guaauuauguggugacagatt

SEQ ID NO: 930 - DNA, 21 bp, Artificial Sequence
  Description of Artificial Sequence: Synthetic oligonucleotide
  Description of Combined DNA/RNA Molecule: Synthetic oligonucleotide
ucugucaccacauaauuactt

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
uaauuauguggugacagautt

SEQ ID NO: 932 - DNA, 21 bp, Artificial Sequence
  Description of Artificial Sequence: Synthetic oligonucleotide
  Description of Combined DNA/RNA Molecule: Synthetic oligonucleotide
aucugucaccacauaauuatt

SEQ ID NO: 933 - DNA, 21 bp, Artificial Sequence
  Description of Artificial Sequence: Synthetic oligonucleotide
  Description of Combined DNA/RNA Molecule: Synthetic oligonucleotide
aauuauguggugacagauctt

SEQ ID NO: 934 - DNA, 21 bp, Artificial Sequence
  Description of Artificial Sequence: Synthetic oligonucleotide
  Description of Combined DNA/RNA Molecule: Synthetic oligonucleotide
gaucugucaccacauaauutt

SEQ ID NO: 935 - DNA, 21 bp, Artificial Sequence
  Description of Artificial Sequence: Synthetic oligonucleotide
  Description of Combined DNA/RNA Molecule: Synthetic oligonucleotide
auuauguggugacagaucatt

SEQ ID NO: 936 - DNA, 21 bp, Artificial Sequence
  Description of Artificial Sequence: Synthetic oligonucleotide
  Description of Combined DNA/RNA Molecule: Synthetic oligonucleotide
ugaucugucaccacauaautt

SEQ ID NO: 937 - DNA, 21 bp, Artificial Sequence
  Description of Artificial Sequence: Synthetic oligonucleotide
  Description of Combined DNA/RNA Molecule: Synthetic oligonucleotide
uuauguggugacagaucactt

SEQ ID NO: 938 - DNA, 21 bp, Artificial Sequence
  Description of Artificial Sequence: Synthetic oligonucleotide
  Description of Combined DNA/RNA Molecule: Synthetic oligonucleotide
gugaucugucaccacauaatt

SEQ ID NO: 939 - DNA, 21 bp, Artificial Sequence
  Description of Artificial Sequence: Synthetic oligonucleotide
  Description of Combined DNA/RNA Molecule: Synthetic oligonucleotide
auguggugacagaucacggtt

SEQ ID NO: 940 - DNA, 21 bp, Artificial Sequence
  Description of Artificial Sequence: Synthetic oligonucleotide
  Description of Combined DNA/RNA Molecule: Synthetic oligonucleotide
ccgugaucugucaccacautt

SEQ ID NO: 941 - DNA, 21 bp, Artificial Sequence
  Description of Artificial Sequence: Synthetic oligonucleotide
  Description of Combined DNA/RNA Molecule: Synthetic oligonucleotide
uggugacagaucacggcuctt

SEQ ID NO: 942 - DNA, 21 bp, Artificial Sequence
  Description of Artificial Sequence: Synthetic oligonucleotide
  Description of Combined DNA/RNA Molecule: Synthetic oligonucleotide
gagccgugaucugucaccatt

SEQ ID NO: 943 - DNA, 21 bp, Artificial Sequence
  Description of Artificial Sequence: Synthetic oligonucleotide
  Description of Combined DNA/RNA Molecule: Synthetic oligonucleotide
gugacagaucacggcucgutt

SEQ ID NO: 944 - DNA, 21 bp, Artificial Sequence
  Description of Artificial Sequence: Synthetic oligonucleotide
  Description of Combined DNA/RNA Molecule: Synthetic oligonucleotide
acgagccgugaucugucactt

SEQ ID NO: 945 - DNA, 21 bp, Artificial Sequence
  Description of Artificial Sequence: Synthetic oligonucleotide
  Description of Combined DNA/RNA Molecule: Synthetic oligonucleotide
ugacagaucacggcucgugtt

SEQ ID NO: 946 - DNA, 21 bp, Artificial Sequence
  Description of Artificial Sequence: Synthetic oligonucleotide
  Description of Combined DNA/RNA Molecule: Synthetic oligonucleotide
cacgagccgugaucugucatt

SEQ ID NO: 947 - DNA, 21 bp, Artificial Sequence
  Description of Artificial Sequence: Synthetic oligonucleotide
  Description of Combined DNA/RNA Molecule: Synthetic oligonucleotide
gacagaucacggcucgugctt

SEQ ID NO: 948 - DNA, 21 bp, Artificial Sequence
  Description of Artificial Sequence: Synthetic oligonucleotide
  Description of Combined DNA/RNA Molecule: Synthetic oligonucleotide
gcacgagccgugaucuguctt

SEQ ID NO: 949 - DNA, 21 bp, Artificial Sequence
  Description of Artificial Sequence: Synthetic oligonucleotide
  Description of Combined DNA/RNA Molecule: Synthetic oligonucleotide
acagaucacggcucgugcgtt

SEQ ID NO: 950 - DNA, 21 bp, Artificial Sequence
  Description of Artificial Sequence: Synthetic oligonucleotide
  Description of Combined DNA/RNA Molecule: Synthetic oligonucleotide
cgcacgagccgugaucugutt

SEQ ID NO: 951 - DNA, 21 bp, Artificial Sequence
  Description of Artificial Sequence: Synthetic oligonucleotide
  Description of Combined DNA/RNA Molecule: Synthetic oligonucleotide
cagaucacggcucgugcgutt

SEQ ID NO: 952 - DNA, 21 bp, Artificial Sequence
  Description of Artificial Sequence: Synthetic oligonucleotide
  Description of Combined DNA/RNA Molecule: Synthetic oligonucleotide
acgcacgagccgugaucugtt

SEQ ID NO: 953 - DNA, 21 bp, Artificial Sequence
  Description of Artificial Sequence: Synthetic oligonucleotide
  Description of Combined DNA/RNA Molecule: Synthetic oligonucleotide
agaucacggcucgugcguctt

SEQ ID NO: 954 - DNA, 21 bp, Artificial Sequence
  Description of Artificial Sequence: Synthetic oligonucleotide
  Description of Combined DNA/RNA Molecule: Synthetic oligonucleotide
gacgcacgagccgugaucutt

SEQ ID NO: 955 - DNA, 21 bp, Artificial Sequence
  Description of Artificial Sequence: Synthetic oligonucleotide
  Description of Combined DNA/RNA Molecule: Synthetic oligonucleotide
gaucacggcucgugcgucctt

SEQ ID NO: 956 - DNA, 21 bp, Artificial Sequence
  Description of Artificial Sequence: Synthetic oligonucleotide
  Description of Combined DNA/RNA Molecule: Synthetic oligonucleotide
ggacgcacgagccgugauctt

SEQ ID NO: 957 - DNA, 21 bp, Artificial Sequence
  Description of Artificial Sequence: Synthetic oligonucleotide
  Description of Combined DNA/RNA Molecule: Synthetic oligonucleotide
aucacggcucgugcguccgtt

SEQ ID NO: 958 - DNA, 21 bp, Artificial Sequence
  Description of Artificial Sequence: Synthetic oligonucleotide
  Description of Combined DNA/RNA Molecule: Synthetic oligonucleotide
cggacgcacgagccgugautt

SEQ ID NO: 959 - DNA, 21 bp, Artificial Sequence
  Description of Artificial Sequence: Synthetic oligonucleotide
  Description of Combined DNA/RNA Molecule: Synthetic oligonucleotide
ucacggcucgugcguccgatt

SEQ ID NO: 960 - DNA, 21 bp, Artificial Sequence
  Description of Artificial Sequence: Synthetic oligonucleotide
  Description of Combined DNA/RNA Molecule: Synthetic oligonucleotide
ucggacgcacgagccgugatt

SEQ ID NO: 961 - DNA, 21 bp, Artificial Sequence
  Description of Artificial Sequence: Synthetic oligonucleotide
  Description of Combined DNA/RNA Molecule: Synthetic oligonucleotide
cacggcucgugcguccgagtt

SEQ ID NO: 962 - DNA, 21 bp, Artificial Sequence
  Description of Artificial Sequence: Synthetic oligonucleotide
  Description of Combined DNA/RNA Molecule: Synthetic oligonucleotide
cucggacgcacgagccgugtt

SEQ ID NO: 963 - DNA, 21 bp, Artificial Sequence
  Description of Artificial Sequence: Synthetic oligonucleotide
  Description of Combined DNA/RNA Molecule: Synthetic oligonucleotide
acggcucgugcguccgagctt

SEQ ID NO: 964 - DNA, 21 bp, Artificial Sequence
  Description of Artificial Sequence: Synthetic oligonucleotide
  Description of Combined DNA/RNA Molecule: Synthetic oligonucleotide
gcucggacgcacgagccgutt

SEQ ID NO: 965 - DNA, 21 bp, Artificial Sequence
  Description of Artificial Sequence: Synthetic oligonucleotide
  Description of Combined DNA/RNA Molecule: Synthetic oligonucleotide
gcucgugcguccgagccugtt

SEQ ID NO: 966 - DNA, 21 bp, Artificial Sequence
  Description of Artificial Sequence: Synthetic oligonucleotide
  Description of Combined DNA/RNA Molecule: Synthetic oligonucleotide
caggcucggacgcacgagctt

SEQ ID NO: 967 - DNA, 21 bp, Artificial Sequence
  Description of Artificial Sequence: Synthetic oligonucleotide
  Description of Combined DNA/RNA Molecule: Synthetic oligonucleotide
ggaggaagacggcguccgctt

SEQ ID NO: 968 - DNA, 21 bp, Artificial Sequence
  Description of Artificial Sequence: Synthetic oligonucleotide
  Description of Combined DNA/RNA Molecule: Synthetic oligonucleotide
gcggacgccgucuuccucctt

SEQ ID NO: 969 - DNA, 21 bp, Artificial Sequence
  Description of Artificial Sequence: Synthetic oligonucleotide
  Description of Combined DNA/RNA Molecule: Synthetic oligonucleotide
gaggaagacggcguccgcatt

SEQ ID NO: 970 - DNA, 21 bp, Artificial Sequence
  Description of Artificial Sequence: Synthetic oligonucleotide
  Description of Combined DNA/RNA Molecule: Synthetic oligonucleotide
ugcggacgccgucuuccuctt

SEQ ID NO: 971 - DNA, 21 bp, Artificial Sequence
  Description of Artificial Sequence: Synthetic oligonucleotide
  Description of Combined DNA/RNA Molecule: Synthetic oligonucleotide
ggaagacggcguccgcaagtt

SEQ ID NO: 972 - DNA, 21 bp, Artificial Sequence
  Description of Artificial Sequence: Synthetic oligonucleotide
  Description of Combined DNA/RNA Molecule: Synthetic oligonucleotide
cuugcggacgccgucuucctt

SEQ ID NO: 973 - DNA, 21 bp, Artificial Sequence
  Description of Artificial Sequence: Synthetic oligonucleotide
  Description of Combined DNA/RNA Molecule: Synthetic oligonucleotide
gaagacggcguccgcaagutt

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
acuugcggacgccgucuuctt

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
aagacggcguccgcaagugtt

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
cacuugcggacgccgucuutt

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
gacggcguccgcaaguguatt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
uacacuugcggacgccguctt

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
acggcguccgcaaguguaatt

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
uuacacuugcggacgccgutt

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
gcguccgcaaguguaagaatt

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
uucuuacacuugcggacgctt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
cguccgcaaguguaagaagtt

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
cuucuuacacuugcggacgtt

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
guccgcaaguguaagaagutt

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
acuucuuacacuugcggactt

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
uccgcaaguguaagaagugtt

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
cacuucuuacacuugcggatt

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
ccgcaaguguaagaagugctt

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
gcacuucuuacacuugcggtt

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
cgcaaguguaagaagugcgtt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
cgcacuucuuacacuugcgtt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
gcaaguguaagaagugcgatt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
ucgcacuucuuacacuugctt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
aaguguaagaagugcgaagtt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
cuucgcacuucuuacacuutt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
aguguaagaagugcgaaggtt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
ccuucgcacuucuuacacutt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
guguaagaagugcgaagggtt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
cccuucgcacuucuuacactt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
uguaagaagugcgaagggctt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
gcccuucgcacuucuuacatt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
guaagaagugcgaagggcctt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
ggcccuucgcacuucuuactt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
uaagaagugcgaagggccutt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
aggcccuucgcacuucuuatt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
aagaagugcgaagggccuutt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
aaggcccuucgcacuucuutt

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
agaagugcgaagggccuugtt

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
caaggcccuucgcacuucutt

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
agugcgaagggccuugccgtt

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
cggcaaggcccuucgcacutt

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
gugcgaagggccuugccgctt

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
gcggcaaggcccuucgcactt

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
ugcgaagggccuugccgcatt

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
ugcggcaaggcccuucgcatt

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
gcgaagggccuugccgcaatt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
uugcggcaaggcccuucgctt

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
cgaagggccuugccgcaaatt

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
uuugcggcaaggcccuucgtt

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
aagggccuugccgcaaagutt

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
acuuugcggcaaggcccuutt

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
agggccuugccgcaaagugtt

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
cacuuugcggcaaggcccutt

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
gggccuugccgcaaagugutt

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
acacuuugcggcaaggccctt

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
ggccuugccgcaaagugugtt

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
cacacuuugcggcaaggcctt

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
gccuugccgcaaagugugutt

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
acacacuuugcggcaaggctt

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
cuugccgcaaaguguguaatt

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
uuacacacuuugcggcaagtt

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
ggaauagguauuggugaautt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
auucaccaauaccuauucctt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
gaauagguauuggugaauutt

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
aauucaccaauaccuauuctt

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
aauagguauuggugaauuutt

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
aaauucaccaauaccuauutt

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
auagguauuggugaauuuatt

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
uaaauucaccaauaccuautt

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
agguauuggugaauuuaaatt

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
uuuaaauucaccaauaccutt

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
gguauuggugaauuuaaagtt

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
cuuuaaauucaccaauacctt

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
cacucuccauaaaugcuactt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
guagcauuuauggagagugtt

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
uuaaacacuucaaaaacugtt

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
caguuuuugaaguguuuaatt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
cuucaaaaacugcaccucctt

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
ggaggugcaguuuuugaagtt

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
uucaaaaacugcaccuccatt

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
uggaggugcaguuuuugaatt

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
ucaaaaacugcaccuccautt

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
auggaggugcaguuuuugatt

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
caaaaacugcaccuccauctt

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
gauggaggugcaguuuuugtt

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
aaaaacugcaccuccaucatt

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
ugauggaggugcaguuuuutt

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
acugcaccuccaucaguggtt

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
ccacugauggaggugcagutt

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
caccuccaucaguggcgautt

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
aucgccacugauggaggugtt

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
accuccaucaguggcgauctt

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
gaucgccacugauggaggutt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
cuccaucaguggcgaucuctt

SEQ ID NO: 1066 - DNA, 21 bp, Artificial Sequence
  Description of Artificial Sequence: Synthetic oligonucleotide
  Description of Combined DNA/RNA Molecule: Synthetic oligonucleotide
gagaucgccacugauggagtt

SEQ ID NO: 1067 - DNA, 21 bp, Artificial Sequence
  Description of Artificial Sequence: Synthetic oligonucleotide
  Description of Combined DNA/RNA Molecule: Synthetic oligonucleotide
caucaguggcgaucuccactt

SEQ ID NO: 1068 - DNA, 21 bp, Artificial Sequence
  Description of Artificial Sequence: Synthetic oligonucleotide
  Description of Combined DNA/RNA Molecule: Synthetic oligonucleotide
guggagaucgccacugaugtt

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
uggcgaucuccacauccugtt

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
caggauguggagaucgccatt

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
ggcgaucuccacauccugctt

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
gcaggauguggagaucgcctt

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
gcgaucuccacauccugcctt

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
ggcaggauguggagaucgctt

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
cgaucuccacauccugccgtt

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
cggcaggauguggagaucgtt

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
gaucuccacauccugccggtt

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
ccggcaggauguggagauctt

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
ccacauccugccgguggcatt

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
ugccaccggcaggauguggtt

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
cacauccugccgguggcautt

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
augccaccggcaggaugugtt

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
acauccugccgguggcauutt

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
aaugccaccggcaggaugutt

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
auccugccgguggcauuuatt

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
uaaaugccaccggcaggautt

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
cugccgguggcauuuagggtt

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
cccuaaaugccaccggcagtt

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
ugccgguggcauuuaggggtt

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
ccccuaaaugccaccggcatt

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
gccgguggcauuuaggggutt

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
accccuaaaugccaccggctt

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
ccgguggcauuuaggggugtt

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
caccccuaaaugccaccggtt

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
guggcauuuaggggugacutt

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
agucaccccuaaaugccactt

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
gcauuuaggggugacuccutt

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
aggagucaccccuaaaugctt

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
cauuuaggggugacuccuutt

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
aaggagucaccccuaaaugtt

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
auuuaggggugacuccuuctt

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
gaaggagucaccccuaaautt

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
uuuaggggugacuccuucatt

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
ugaaggagucaccccuaaatt

SEQ ID NO: 1105 - DNA, 21 bp, Artificial Sequence
  Description of Artificial Sequence: Synthetic oligonucleotide
  Description of Combined DNA/RNA Molecule: Synthetic oligonucleotide
uuaggggugacuccuucactt

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
gugaaggagucaccccuaatt

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
uaggggugacuccuucacatt

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
ugugaaggagucaccccuatt

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
ucuggauccacaggaacugtt

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
caguuccuguggauccagatt

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
gauccacaggaacuggauatt

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
uauccaguuccuguggauctt

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
auccacaggaacuggauautt

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
auauccaguuccuguggautt

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
ccacaggaacuggauauuctt

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
gaauauccaguuccuguggtt

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
cacaggaacuggauauucutt

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
agaauauccaguuccugugtt

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
acuggauauucugaaaacctt

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
gguuuucagaauauccagutt

SEQ ID NO: 1121 - DNA, 21 bp, Artificial Sequence
  Description of Artificial Sequence: Synthetic oligonucleotide
  Description of Combined DNA/RNA Molecule: Synthetic oligonucleotide
auucugaaaaccguaaaggtt

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
ccuuuacgguuuucagaautt

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
uucugaaaaccguaaaggatt

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
uccuuuacgguuuucagaatt

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
ugaaaaccguaaaggaaautt

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
auuuccuuuacgguuuucatt

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
gaaaaccguaaaggaaauctt

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
gauuuccuuuacgguuuuctt

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
cggccggagucccgagcuatt

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
uagcucgggacuccggccgtt

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
ccggagucccgagcuagcctt

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
ggcuagcucgggacuccggtt

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
cggagucccgagcuagccctt

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
gggcuagcucgggacuccgtt

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
ggagucccgagcuagcccctt

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
ggggcuagcucgggacucctt

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
gagucccgagcuagccccgtt

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
cggggcuagcucgggacuctt

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
agucccgagcuagccccggtt

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
ccggggcuagcucgggacutt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
gucccgagcuagccccggctt

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
gccggggcuagcucgggactt

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
cccgagcuagccccggcggtt

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
ccgccggggcuagcucgggtt

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
ggacgacaggccaccucgutt

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
acgagguggccugucgucctt

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
gacgacaggccaccucguctt

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
gacgagguggccugucguctt

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
acgacaggccaccucgucgtt

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
cgacgagguggccugucgutt

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
cgacaggccaccucgucggtt

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
ccgacgagguggccugucgtt

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
gacaggccaccucgucggctt

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
gccgacgagguggccuguctt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
caggccaccucgucggcgutt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
acgccgacgagguggccugtt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
aggccaccucgucggcguctt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
gacgccgacgagguggccutt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
ggccaccucgucggcgucctt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
ggacgccgacgagguggcctt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
gccaccucgucggcguccgtt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
cggacgccgacgagguggctt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
ccaccucgucggcguccgctt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
gcggacgccgacgagguggtt

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
caccucgucggcguccgcctt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
ggcggacgccgacgaggugtt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
accucgucggcguccgccctt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
gggcggacgccgacgaggutt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
ccucgucggcguccgcccgtt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
cgggcggacgccgacgaggtt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
cucgucggcguccgcccgatt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
ucgggcggacgccgacgagtt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
ucgucggcguccgcccgagtt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
cucgggcggacgccgacgatt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
cgucggcguccgcccgagutt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
acucgggcggacgccgacgtt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
gucggcguccgcccgaguctt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
gacucgggcggacgccgactt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
ucggcguccgcccgagucctt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
ggacucgggcggacgccgatt

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
gcguccgcccgaguccccgtt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
cggggacucgggcggacgctt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
cguccgcccgaguccccgctt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
gcggggacucgggcggacgtt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
gcccgaguccccgccucgctt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
gcgaggcggggacucgggctt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
aacgccacaaccaccgcgctt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
gcgcggugguuguggcguutt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
acgccacaaccaccgcgcatt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
ugcgcggugguuguggcgutt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
cgccacaaccaccgcgcactt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
gugcgcggugguuguggcgtt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
ccacaaccaccgcgcacggtt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
ccgugcgcggugguuguggtt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
cacaaccaccgcgcacggctt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
gccgugcgcggugguugugtt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
acaaccaccgcgcacggcctt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
ggccgugcgcggugguugutt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
augcgacccuccgggacggtt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
ccgucccggagggucgcautt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
ugcgacccuccgggacggctt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
gccgucccggagggucgcatt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
gcgacccuccgggacggcctt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
ggccgucccggagggucgctt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
gacccuccgggacggccggtt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
ccggccgucccggaggguctt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
acccuccgggacggccgggtt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
cccggccgucccggagggutt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
ccuccgggacggccggggctt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
gccccggccgucccggaggtt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
agaaaguuugccaaggcactt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
gugccuuggcaaacuuucutt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
gaaaguuugccaaggcacgtt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
cgugccuuggcaaacuuuctt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
aaguuugccaaggcacgagtt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
cucgugccuuggcaaacuutt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
aguuugccaaggcacgagutt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
guuugccaaggcacgaguatt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
uacucgugccuuggcaaactt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
uuugccaaggcacgaguaatt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
uuacucgugccuuggcaaatt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
uugccaaggcacgaguaactt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
guuacucgugccuuggcaatt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
ugccaaggcacgaguaacatt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
uguuacucgugccuuggcatt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
gccaaggcacgaguaacaatt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
uuguuacucgugccuuggctt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
acgcaguugggcacuuuugtt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
caaaagugcccaacugcgutt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
cgcaguugggcacuuuugatt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
ucaaaagugcccaacugcgtt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
gcaguugggcacuuuugaatt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
uucaaaagugcccaacugctt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
caguugggcacuuuugaagtt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
cuucaaaagugcccaacugtt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
aguugggcacuuuugaagatt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
ucuucaaaagugcccaacutt

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
guugggcacuuuugaagautt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
aucuucaaaagugcccaactt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
uugggcacuuuugaagauctt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
gaucuucaaaagugcccaatt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
ugggcacuuuugaagaucatt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
ugaucuucaaaagugcccatt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
gggcacuuuugaagaucautt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
augaucuucaaaagugccctt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
uugaagaucauuuucucagtt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
cugagaaaaugaucuucaatt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
gaagaucauuuucucagcctt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
ggcugagaaaaugaucuuctt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
aagaucauuuucucagccutt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
aggcugagaaaaugaucuutt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
cauuuucucagccuccagatt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
ucuggaggcugagaaaaugtt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
agccuccagaggauguucatt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
ugaacauccucuggaggcutt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
ccuccagaggauguucaautt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
auugaacauccucuggaggtt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
cuccagaggauguucaauatt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
uauugaacauccucuggagtt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
agaggauguucaauaacugtt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
caguuauugaacauccucutt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
aggauguucaauaacugugtt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
cacaguuauugaacauccutt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
uguucaauaacugugaggutt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
accucacaguuauugaacatt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
uucaauaacugugagguggtt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
ccaccucacaguuauugaatt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ucaauaacugugagguggutt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
accaccucacaguuauugatt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
caauaacugugaggugguctt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
gaccaccucacaguuauugtt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
aauaacugugagguggucctt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
ggaccaccucacaguuauutt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
auaacugugaggugguccutt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
aggaccaccucacaguuautt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
uaacugugaggugguccuutt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
aaggaccaccucacaguuatt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
acugugaggugguccuuggtt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
ccaaggaccaccucacagutt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
ugugaggugguccuugggatt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
ucccaaggaccaccucacatt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
gugaggugguccuugggaatt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
uucccaaggaccaccucactt

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
ugguccuugggaauuuggatt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
uccaaauucccaaggaccatt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
uugggaauuuggaaauuactt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
guaauuuccaaauucccaatt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
ugggaauuuggaaauuacctt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
gguaauuuccaaauucccatt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
gggaauuuggaaauuaccutt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
agguaauuuccaaauuccctt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
ggaauuuggaaauuaccuatt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
uagguaauuuccaaauucctt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
agaggaauuaugaucuuuctt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
gaaagaucauaauuccucutt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
gaggaauuaugaucuuucctt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
ggaaagaucauaauuccuctt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
aauuaugaucuuuccuucutt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
agaaggaaagaucauaauutt

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
auuaugaucuuuccuucuutt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
aagaaggaaagaucauaautt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
uaugaucuuuccuucuuaatt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
uuaagaaggaaagaucauatt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
ugaucuuuccuucuuaaagtt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
cuuuaagaaggaaagaucatt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
ucuuuccuucuuaaagacctt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
ggucuuuaagaaggaaagatt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
ccuucuuaaagaccauccatt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
uggauggucuuuaagaaggtt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
cuucuuaaagaccauccagtt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
cuggauggucuuuaagaagtt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
ucuuaaagaccauccaggatt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
uccuggauggucuuuaagatt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
uuaaagaccauccaggaggtt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
ccuccuggauggucuuuaatt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
uaaagaccauccaggaggutt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
accuccuggauggucuuuatt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
ccaggagguggcugguuautt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
auaaccagccaccuccuggtt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
caggagguggcugguuaugtt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
cauaaccagccaccuccugtt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
aggagguggcugguuaugutt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
acauaaccagccaccuccutt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
ggagguggcugguuauguctt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
gacauaaccagccaccucctt

SEQ ID NO: 1327 - DNA, 21 bp, Artificial Sequence
  Description of Artificial Sequence: Synthetic oligonucleotide
  Description of Combined DNA/RNA Molecule: Synthetic oligonucleotide
gagguggcugguuaugucctt

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
ggacauaaccagccaccuctt

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
agguggcugguuauguccutt

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
aggacauaaccagccaccutt

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
guggcugguuauguccucatt

SEQ ID NO: 1332 - DNA, 21 bp, Artificial Sequence
  Description of Artificial Sequence: Synthetic oligonucleotide
  Description of Combined DNA/RNA Molecule: Synthetic oligonucleotide
ugaggacauaaccagccactt

SEQ ID NO: 1333 - DNA, 21 bp, Artificial Sequence
  Description of Artificial Sequence: Synthetic oligonucleotide
  Description of Combined DNA/RNA Molecule: Synthetic oligonucleotide
gcccucaacacaguggagctt

SEQ ID NO: 1334 - DNA, 21 bp, Artificial Sequence
  Description of Artificial Sequence: Synthetic oligonucleotide
  Description of Combined DNA/RNA Molecule: Synthetic oligonucleotide
gcuccacuguguugagggctt

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
uuccuuuggaaaaccugcatt

SEQ ID NO: 1336 - DNA, 21 bp, Artificial Sequence
  Description of Artificial Sequence: Synthetic oligonucleotide
  Description of Combined DNA/RNA Molecule: Synthetic oligonucleotide
ugcagguuuuccaaaggaatt

SEQ ID NO: 1337 - DNA, 21 bp, Artificial Sequence
  Description of Artificial Sequence: Synthetic oligonucleotide
  Description of Combined DNA/RNA Molecule: Synthetic oligonucleotide
uccuuuggaaaaccugcagtt

SEQ ID NO: 1338 - DNA, 21 bp, Artificial Sequence
  Description of Artificial Sequence: Synthetic oligonucleotide
  Description of Combined DNA/RNA Molecule: Synthetic oligonucleotide
cugcagguuuuccaaaggatt

SEQ ID NO: 1339 - DNA, 21 bp, Artificial Sequence
  Description of Artificial Sequence: Synthetic oligonucleotide
  Description of Combined DNA/RNA Molecule: Synthetic oligonucleotide
gaaaaccugcagaucaucatt

SEQ ID NO: 1340 - DNA, 21 bp, Artificial Sequence
  Description of Artificial Sequence: Synthetic oligonucleotide
  Description of Combined DNA/RNA Molecule: Synthetic oligonucleotide
ugaugaucugcagguuuuctt

SEQ ID NO: 1341 - DNA, 21 bp, Artificial Sequence
  Description of Artificial Sequence: Synthetic oligonucleotide
  Description of Combined DNA/RNA Molecule: Synthetic oligonucleotide
aaaaccugcagaucaucagtt

SEQ ID NO: 1342 - DNA, 21 bp, Artificial Sequence
  Description of Artificial Sequence: Synthetic oligonucleotide
  Description of Combined DNA/RNA Molecule: Synthetic oligonucleotide
cugaugaucugcagguuuutt

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
aaccugcagaucaucagagtt

SEQ ID NO: 1344 - DNA, 21 bp, Artificial Sequence
  Description of Artificial Sequence: Synthetic oligonucleotide
  Description of Combined DNA/RNA Molecule: Synthetic oligonucleotide
cucugaugaucugcagguutt

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
cugcagaucaucagaggaatt

SEQ ID NO: 1346 - DNA, 21 bp, Artificial Sequence
  Description of Artificial Sequence: Synthetic oligonucleotide
  Description of Combined DNA/RNA Molecule: Synthetic oligonucleotide
uuccucugaugaucugcagtt

SEQ ID NO: 1347 - DNA, 21 bp, Artificial Sequence
  Description of Artificial Sequence: Synthetic oligonucleotide
  Description of Combined DNA/RNA Molecule: Synthetic oligonucleotide
gaaaauuccuaugccuuagtt

SEQ ID NO: 1348 - DNA, 21 bp, Artificial Sequence
  Description of Artificial Sequence: Synthetic oligonucleotide
  Description of Combined DNA/RNA Molecule: Synthetic oligonucleotide
cuaaggcauaggaauuuuctt

SEQ ID NO: 1349 - DNA, 21 bp, Artificial Sequence
  Description of Artificial Sequence: Synthetic oligonucleotide
  Description of Combined DNA/RNA Molecule: Synthetic oligonucleotide
aaaauuccuaugccuuagctt

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
gcuaaggcauaggaauuuutt

SEQ ID NO: 1351 - DNA, 21 bp, Artificial Sequence
  Description of Artificial Sequence: Synthetic oligonucleotide
  Description of Combined DNA/RNA Molecule: Synthetic oligonucleotide
aauuccuaugccuuagcagtt

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
cugcuaaggcauaggaauutt

SEQ ID NO: 1353 - DNA, 21 bp, Artificial Sequence
  Description of Artificial Sequence: Synthetic oligonucleotide
  Description of Combined DNA/RNA Molecule: Synthetic oligonucleotide
uccuaugccuuagcagucutt

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
agacugcuaaggcauaggatt

SEQ ID NO: 1355 - DNA, 21 bp, Artificial Sequence
  Description of Artificial Sequence: Synthetic oligonucleotide
  Description of Combined DNA/RNA Molecule: Synthetic oligonucleotide
ccuaugccuuagcagucuutt

SEQ ID NO: 1356 - DNA, 21 bp, Artificial Sequence
  Description of Artificial Sequence: Synthetic oligonucleotide
  Description of Combined DNA/RNA Molecule: Synthetic oligonucleotide
aagacugcuaaggcauaggtt

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
cuaugccuuagcagucuuatt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
uaagacugcuaaggcauagtt

SEQ ID NO: 1359 - DNA, 21 bp, Artificial Sequence
  Description of Artificial Sequence: Synthetic oligonucleotide
  Description of Combined DNA/RNA Molecule: Synthetic oligonucleotide
augccuuagcagucuuauctt

SEQ ID NO: 1360 - DNA, 21 bp, Artificial Sequence
  Description of Artificial Sequence: Synthetic oligonucleotide
  Description of Combined DNA/RNA Molecule: Synthetic oligonucleotide
gauaagacugcuaaggcautt

SEQ ID NO: 1361 - DNA, 21 bp, Artificial Sequence
  Description of Artificial Sequence: Synthetic oligonucleotide
  Description of Combined DNA/RNA Molecule: Synthetic oligonucleotide
ugccuuagcagucuuaucutt

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
agauaagacugcuaaggcatt

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
gccuuagcagucuuaucuatt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
uagauaagacugcuaaggctt

SEQ ID NO: 1365 - DNA, 21 bp, Artificial Sequence
  Description of Artificial Sequence: Synthetic oligonucleotide
  Description of Combined DNA/RNA Molecule: Synthetic oligonucleotide
ccuuagcagucuuaucuaatt

SEQ ID NO: 1366 - DNA, 21 bp, Artificial Sequence
  Description of Artificial Sequence: Synthetic oligonucleotide
  Description of Combined DNA/RNA Molecule: Synthetic oligonucleotide
uuagauaagacugcuaaggtt

SEQ ID NO: 1367 - DNA, 21 bp, Artificial Sequence
  Description of Artificial Sequence: Synthetic oligonucleotide
  Description of Combined DNA/RNA Molecule: Synthetic oligonucleotide
cuuagcagucuuaucuaactt

SEQ ID NO: 1368 - DNA, 21 bp, Artificial Sequence
  Description of Artificial Sequence: Synthetic oligonucleotide
  Description of Combined DNA/RNA Molecule: Synthetic oligonucleotide
guuagauaagacugcuaagtt

SEQ ID NO: 1369 - DNA, 21 bp, Artificial Sequence
  Description of Artificial Sequence: Synthetic oligonucleotide
  Description of Combined DNA/RNA Molecule: Synthetic oligonucleotide
uuagcagucuuaucuaacutt

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
aguuagauaagacugcuaatt

SEQ ID NO: 1371 - DNA, 21 bp, Artificial Sequence
  Description of Artificial Sequence: Synthetic oligonucleotide
  Description of Combined DNA/RNA Molecule: Synthetic oligonucleotide
uagcagucuuaucuaacuatt

SEQ ID NO: 1372 - DNA, 21 bp, Artificial Sequence
  Description of Artificial Sequence: Synthetic oligonucleotide
  Description of Combined DNA/RNA Molecule: Synthetic oligonucleotide
uaguuagauaagacugcuatt

SEQ ID NO: 1373 - DNA, 21 bp, Artificial Sequence
  Description of Artificial Sequence: Synthetic oligonucleotide
  Description of Combined DNA/RNA Molecule: Synthetic oligonucleotide
agcagucuuaucuaacuautt

SEQ ID NO: 1374 - DNA, 21 bp, Artificial Sequence
  Description of Artificial Sequence: Synthetic oligonucleotide
  Description of Combined DNA/RNA Molecule: Synthetic oligonucleotide
auaguuagauaagacugcutt

SEQ ID NO: 1375 - DNA, 21 bp, Artificial Sequence
  Description of Artificial Sequence: Synthetic oligonucleotide
  Description of Combined DNA/RNA Molecule: Synthetic oligonucleotide
gcagucuuaucuaacuaugtt

SEQ ID NO: 1376 - DNA, 21 bp, Artificial Sequence
  Description of Artificial Sequence: Synthetic oligonucleotide
  Description of Combined DNA/RNA Molecule: Synthetic oligonucleotide
cauaguuagauaagacugctt

SEQ ID NO: 1377 - DNA, 21 bp, Artificial Sequence
  Description of Artificial Sequence: Synthetic oligonucleotide
  Description of Combined DNA/RNA Molecule: Synthetic oligonucleotide
cagucuuaucuaacuaugatt

SEQ ID NO: 1378 - DNA, 21 bp, Artificial Sequence
  Description of Artificial Sequence: Synthetic oligonucleotide
  Description of Combined DNA/RNA Molecule: Synthetic oligonucleotide
ucauaguuagauaagacugtt

SEQ ID NO: 1379 - DNA, 21 bp, Artificial Sequence
  Description of Artificial Sequence: Synthetic oligonucleotide
  Description of Combined DNA/RNA Molecule: Synthetic oligonucleotide
ucuuaucuaacuaugaugctt

SEQ ID NO: 1380 - DNA, 21 bp, Artificial Sequence
  Description of Artificial Sequence: Synthetic oligonucleotide
  Description of Combined DNA/RNA Molecule: Synthetic oligonucleotide
gcaucauaguuagauaagatt

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
cuuaucuaacuaugaugcatt

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
ugcaucauaguuagauaagtt

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
uuaucuaacuaugaugcaatt

SEQ ID NO: 1384 - DNA, 21 bp, Artificial Sequence
  Description of Artificial Sequence: Synthetic oligonucleotide
  Description of Combined DNA/RNA Molecule: Synthetic oligonucleotide
uugcaucauaguuagauaatt

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
uaucuaacuaugaugcaaatt

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
uuugcaucauaguuagauatt

SEQ ID NO: 1387 - DNA, 21 bp, Artificial Sequence
  Description of Artificial Sequence: Synthetic oligonucleotide
  Description of Combined DNA/RNA Molecule: Synthetic oligonucleotide
aucuaacuaugaugcaaautt

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
auuugcaucauaguuagautt

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
ucuaacuaugaugcaaauatt

SEQ ID NO: 1390 - DNA, 21 bp, Artificial Sequence
  Description of Artificial Sequence: Synthetic oligonucleotide
  Description of Combined DNA/RNA Molecule: Synthetic oligonucleotide
uauuugcaucauaguuagatt

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
cuaacuaugaugcaaauaatt

SEQ ID NO: 1392 - DNA, 21 bp, Artificial Sequence
  Description of Artificial Sequence: Synthetic oligonucleotide
  Description of Combined DNA/RNA Molecule: Synthetic oligonucleotide
uuauuugcaucauaguuagtt

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
aacuaugaugcaaauaaaatt

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
uuuuauuugcaucauaguutt

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
gaugcaaauaaaaccggactt

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
guccgguuuuauuugcauctt

SEQ ID NO: 1397 - DNA, 21 bp, Artificial Sequence
  Description of Artificial Sequence: Synthetic oligonucleotide
  Description of Combined DNA/RNA Molecule: Synthetic oligonucleotide
augcaaauaaaaccggacutt

SEQ ID NO: 1398 - DNA, 21 bp, Artificial Sequence
  Description of Artificial Sequence: Synthetic oligonucleotide
  Description of Combined DNA/RNA Molecule: Synthetic oligonucleotide
aguccgguuuuauuugcautt

SEQ ID NO: 1399 - DNA, 21 bp, Artificial Sequence
  Description of Artificial Sequence: Synthetic oligonucleotide
  Description of Combined DNA/RNA Molecule: Synthetic oligonucleotide
ugcaaauaaaaccggacugtt

SEQ ID NO: 1400 - DNA, 21 bp, Artificial Sequence
  Description of Artificial Sequence: Synthetic oligonucleotide
  Description of Combined DNA/RNA Molecule: Synthetic oligonucleotide
caguccgguuuuauuugcatt

SEQ ID NO: 1401 - DNA, 21 bp, Artificial Sequence
  Description of Artificial Sequence: Synthetic oligonucleotide
  Description of Combined DNA/RNA Molecule: Synthetic oligonucleotide
caaauaaaaccggacugaatt

SEQ ID NO: 1402 - DNA, 21 bp, Artificial Sequence
  Description of Artificial Sequence: Synthetic oligonucleotide
  Description of Combined DNA/RNA Molecule: Synthetic oligonucleotide
uucaguccgguuuuauuugtt

SEQ ID NO: 1403 - DNA, 21 bp, Artificial Sequence
  Description of Artificial Sequence: Synthetic oligonucleotide
  Description of Combined DNA/RNA Molecule: Synthetic oligonucleotide
aaauaaaaccggacugaagtt

SEQ ID NO: 1404 - DNA, 21 bp, Artificial Sequence
  Description of Artificial Sequence: Synthetic oligonucleotide
  Description of Combined DNA/RNA Molecule: Synthetic oligonucleotide
cuucaguccgguuuuauuutt

SEQ ID NO: 1405 - DNA, 21 bp, Artificial Sequence
  Description of Artificial Sequence: Synthetic oligonucleotide
  Description of Combined DNA/RNA Molecule: Synthetic oligonucleotide
aauaaaaccggacugaaggtt

SEQ ID NO: 1406 - DNA, 21 bp, Artificial Sequence
  Description of Artificial Sequence: Synthetic oligonucleotide
  Description of Combined DNA/RNA Molecule: Synthetic oligonucleotide
ccuucaguccgguuuuauutt

SEQ ID NO: 1407 - DNA, 21 bp, Artificial Sequence
  Description of Artificial Sequence: Synthetic oligonucleotide
  Description of Combined DNA/RNA Molecule: Synthetic oligonucleotide
uaaaaccggacugaaggagtt

SEQ ID NO: 1408 - DNA, 21 bp, Artificial Sequence
  Description of Artificial Sequence: Synthetic oligonucleotide
  Description of Combined DNA/RNA Molecule: Synthetic oligonucleotide
cuccuucaguccgguuuuatt

SEQ ID NO: 1409 - DNA, 21 bp, Artificial Sequence
  Description of Artificial Sequence: Synthetic oligonucleotide
  Description of Combined DNA/RNA Molecule: Synthetic oligonucleotide
aaaaccggacugaaggagctt

SEQ ID NO: 1410 - DNA, 21 bp, Artificial Sequence
  Description of Artificial Sequence: Synthetic oligonucleotide
  Description of Combined DNA/RNA Molecule: Synthetic oligonucleotide
gcuccuucaguccgguuuutt

SEQ ID NO: 1411 - DNA, 21 bp, Artificial Sequence
  Description of Artificial Sequence: Synthetic oligonucleotide
  Description of Combined DNA/RNA Molecule: Synthetic oligonucleotide
aaaccggacugaaggagcutt

SEQ ID NO: 1412 - DNA, 21 bp, Artificial Sequence
  Description of Artificial Sequence: Synthetic oligonucleotide
  Description of Combined DNA/RNA Molecule: Synthetic oligonucleotide
agcuccuucaguccgguuutt

SEQ ID NO: 1413 - DNA, 21 bp, Artificial Sequence
  Description of Artificial Sequence: Synthetic oligonucleotide
  Description of Combined DNA/RNA Molecule: Synthetic oligonucleotide
aaccggacugaaggagcugtt

SEQ ID NO: 1414 - DNA, 21 bp, Artificial Sequence
  Description of Artificial Sequence: Synthetic oligonucleotide
  Description of Combined DNA/RNA Molecule: Synthetic oligonucleotide
cagcuccuucaguccgguutt

SEQ ID NO: 1415 - DNA, 21 bp, Artificial Sequence
  Description of Artificial Sequence: Synthetic oligonucleotide
  Description of Combined DNA/RNA Molecule: Synthetic oligonucleotide
aggagcugcccaugagaaatt

SEQ ID NO: 1416 - DNA, 21 bp, Artificial Sequence
  Description of Artificial Sequence: Synthetic oligonucleotide
  Description of Combined DNA/RNA Molecule: Synthetic oligonucleotide
uuucucaugggcagcuccutt

SEQ ID NO: 1417 - DNA, 21 bp, Artificial Sequence
  Description of Artificial Sequence: Synthetic oligonucleotide
  Description of Combined DNA/RNA Molecule: Synthetic oligonucleotide
uacaggaaauccugcauggtt

SEQ ID NO: 1418 - DNA, 21 bp, Artificial Sequence
  Description of Artificial Sequence: Synthetic oligonucleotide
  Description of Combined DNA/RNA Molecule: Synthetic oligonucleotide
ccaugcaggauuuccuguatt

SEQ ID NO: 1419 - DNA, 21 bp, Artificial Sequence
  Description of Artificial Sequence: Synthetic oligonucleotide
  Description of Combined DNA/RNA Molecule: Synthetic oligonucleotide
aggaaauccugcauggcgctt

SEQ ID NO: 1420 - DNA, 21 bp, Artificial Sequence
  Description of Artificial Sequence: Synthetic oligonucleotide
  Description of Combined DNA/RNA Molecule: Synthetic oligonucleotide
gcgccaugcaggauuuccutt

SEQ ID NO: 1421 - DNA, 21 bp, Artificial Sequence
  Description of Artificial Sequence: Synthetic oligonucleotide
  Description of Combined DNA/RNA Molecule: Synthetic oligonucleotide
ggaaauccugcauggcgcctt

SEQ ID NO: 1422 - DNA, 21 bp, Artificial Sequence
  Description of Artificial Sequence: Synthetic oligonucleotide
  Description of Combined DNA/RNA Molecule: Synthetic oligonucleotide
ggcgccaugcaggauuucctt

SEQ ID NO: 1423 - DNA, 21 bp, Artificial Sequence
  Description of Artificial Sequence: Synthetic oligonucleotide
  Description of Combined DNA/RNA Molecule: Synthetic oligonucleotide
gaaauccugcauggcgccgtt

SEQ ID NO: 1424 - DNA, 21 bp, Artificial Sequence
  Description of Artificial Sequence: Synthetic oligonucleotide
  Description of Combined DNA/RNA Molecule: Synthetic oligonucleotide
cggcgccaugcaggauuuctt

SEQ ID NO: 1425 - DNA, 21 bp, Artificial Sequence
  Description of Artificial Sequence: Synthetic oligonucleotide
  Description of Combined DNA/RNA Molecule: Synthetic oligonucleotide
aaauccugcauggcgccgutt

SEQ ID NO: 1426 - DNA, 21 bp, Artificial Sequence
  Description of Artificial Sequence: Synthetic oligonucleotide
  Description of Combined DNA/RNA Molecule: Synthetic oligonucleotide
acggcgccaugcaggauuutt

SEQ ID NO: 1427 - DNA, 21 bp, Artificial Sequence
  Description of Artificial Sequence: Synthetic oligonucleotide
  Description of Combined DNA/RNA Molecule: Synthetic oligonucleotide
aauccugcauggcgccgugtt

SEQ ID NO: 1428 - DNA, 21 bp, Artificial Sequence
  Description of Artificial Sequence: Synthetic oligonucleotide
  Description of Combined DNA/RNA Molecule: Synthetic oligonucleotide
cacggcgccaugcaggauutt

SEQ ID NO: 1429 - DNA, 21 bp, Artificial Sequence
  Description of Artificial Sequence: Synthetic oligonucleotide
  Description of Combined DNA/RNA Molecule: Synthetic oligonucleotide
uccugcauggcgccgugcgtt

SEQ ID NO: 1430 - DNA, 21 bp, Artificial Sequence
  Description of Artificial Sequence: Synthetic oligonucleotide
  Description of Combined DNA/RNA Molecule: Synthetic oligonucleotide
cgcacggcgccaugcaggatt

SEQ ID NO: 1431 - DNA, 21 bp, Artificial Sequence
  Description of Artificial Sequence: Synthetic oligonucleotide
  Description of Combined DNA/RNA Molecule: Synthetic oligonucleotide
cugcauggcgccgugcggutt

SEQ ID NO: 1432 - DNA, 21 bp, Artificial Sequence
  Description of Artificial Sequence: Synthetic oligonucleotide
  Description of Combined DNA/RNA Molecule: Synthetic oligonucleotide
accgcacggcgccaugcagtt

SEQ ID NO: 1433 - DNA, 21 bp, Artificial Sequence
  Description of Artificial Sequence: Synthetic oligonucleotide
  Description of Combined DNA/RNA Molecule: Synthetic oligonucleotide
ugcauggcgccgugcgguutt

SEQ ID NO: 1434 - DNA, 21 bp, Artificial Sequence
  Description of Artificial Sequence: Synthetic oligonucleotide
  Description of Combined DNA/RNA Molecule: Synthetic oligonucleotide
aaccgcacggcgccaugcatt

SEQ ID NO: 1435 - DNA, 21 bp, Artificial Sequence
  Description of Artificial Sequence: Synthetic oligonucleotide
  Description of Combined DNA/RNA Molecule: Synthetic oligonucleotide
gcauggcgccgugcgguuctt

SEQ ID NO: 1436 - DNA, 21 bp, Artificial Sequence
  Description of Artificial Sequence: Synthetic oligonucleotide
  Description of Combined DNA/RNA Molecule: Synthetic oligonucleotide
gaaccgcacggcgccaugctt

SEQ ID NO: 1437 - DNA, 21 bp, Artificial Sequence
  Description of Artificial Sequence: Synthetic oligonucleotide
  Description of Combined DNA/RNA Molecule: Synthetic oligonucleotide
auggcgccgugcgguucagtt

SEQ ID NO: 1438 - DNA, 21 bp, Artificial Sequence
  Description of Artificial Sequence: Synthetic oligonucleotide
  Description of Combined DNA/RNA Molecule: Synthetic oligonucleotide
cugaaccgcacggcgccautt

SEQ ID NO: 1439 - DNA, 21 bp, Artificial Sequence
  Description of Artificial Sequence: Synthetic oligonucleotide
  Description of Combined DNA/RNA Molecule: Synthetic oligonucleotide
uggcgccgugcgguucagctt

SEQ ID NO: 1440 - DNA, 21 bp, Artificial Sequence
  Description of Artificial Sequence: Synthetic oligonucleotide
  Description of Combined DNA/RNA Molecule: Synthetic oligonucleotide
gcugaaccgcacggcgccatt

SEQ ID NO: 1441 - DNA, 21 bp, Artificial Sequence
  Description of Artificial Sequence: Synthetic oligonucleotide
  Description of Combined DNA/RNA Molecule: Synthetic oligonucleotide
ggcgccgugcgguucagcatt

SEQ ID NO: 1442 - DNA, 21 bp, Artificial Sequence
  Description of Artificial Sequence: Synthetic oligonucleotide
  Description of Combined DNA/RNA Molecule: Synthetic oligonucleotide
ugcugaaccgcacggcgcctt

SEQ ID NO: 1443 - DNA, 21 bp, Artificial Sequence
  Description of Artificial Sequence: Synthetic oligonucleotide
  Description of Combined DNA/RNA Molecule: Synthetic oligonucleotide
gcgccgugcgguucagcaatt

SEQ ID NO: 1444 - DNA, 21 bp, Artificial Sequence
  Description of Artificial Sequence: Synthetic oligonucleotide
  Description of Combined DNA/RNA Molecule: Synthetic oligonucleotide
uugcugaaccgcacggcgctt

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
cgccgugcgguucagcaactt

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
guugcugaaccgcacggcgtt

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
gccgugcgguucagcaacatt

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
uguugcugaaccgcacggctt

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
ccgugcgguucagcaacaatt

SEQ ID NO: 1450 - DNA, 21 bp, Artificial Sequence
  Description of Artificial Sequence: Synthetic oligonucleotide
  Description of Combined DNA/RNA Molecule: Synthetic oligonucleotide
uuguugcugaaccgcacggtt

SEQ ID NO: 1451 - DNA, 21 bp, Artificial Sequence
  Description of Artificial Sequence: Synthetic oligonucleotide
  Description of Combined DNA/RNA Molecule: Synthetic oligonucleotide
gugcgguucagcaacaacctt

SEQ ID NO: 1452 - DNA, 21 bp, Artificial Sequence
  Description of Artificial Sequence: Synthetic oligonucleotide
  Description of Combined DNA/RNA Molecule: Synthetic oligonucleotide
gguuguugcugaaccgcactt

SEQ ID NO: 1453 - DNA, 21 bp, Artificial Sequence
  Description of Artificial Sequence: Synthetic oligonucleotide
  Description of Combined DNA/RNA Molecule: Synthetic oligonucleotide
gcgguucagcaacaacccutt

SEQ ID NO: 1454 - DNA, 21 bp, Artificial Sequence
  Description of Artificial Sequence: Synthetic oligonucleotide
  Description of Combined DNA/RNA Molecule: Synthetic oligonucleotide
aggguuguugcugaaccgctt

SEQ ID NO: 1455 - DNA, 21 bp, Artificial Sequence
  Description of Artificial Sequence: Synthetic oligonucleotide
  Description of Combined DNA/RNA Molecule: Synthetic oligonucleotide
gguucagcaacaacccugctt

SEQ ID NO: 1456 - DNA, 21 bp, Artificial Sequence
  Description of Artificial Sequence: Synthetic oligonucleotide
  Description of Combined DNA/RNA Molecule: Synthetic oligonucleotide
gcaggguuguugcugaacctt

SEQ ID NO: 1457 - DNA, 21 bp, Artificial Sequence
  Description of Artificial Sequence: Synthetic oligonucleotide
  Description of Combined DNA/RNA Molecule: Synthetic oligonucleotide
gcaacaacccugcccugugtt

SEQ ID NO: 1458 - DNA, 21 bp, Artificial Sequence
  Description of Artificial Sequence: Synthetic oligonucleotide
  Description of Combined DNA/RNA Molecule: Synthetic oligonucleotide
cacagggcaggguuguugctt

SEQ ID NO: 1459 - DNA, 21 bp, Artificial Sequence
  Description of Artificial Sequence: Synthetic oligonucleotide
  Description of Combined DNA/RNA Molecule: Synthetic oligonucleotide
aacaacccugcccugugcatt

SEQ ID NO: 1460 - DNA, 21 bp, Artificial Sequence
  Description of Artificial Sequence: Synthetic oligonucleotide
  Description of Combined DNA/RNA Molecule: Synthetic oligonucleotide
ugcacagggcaggguuguutt

SEQ ID NO: 1461 - DNA, 21 bp, Artificial Sequence
  Description of Artificial Sequence: Synthetic oligonucleotide
  Description of Combined DNA/RNA Molecule: Synthetic oligonucleotide
acguggagagcauccagugtt

SEQ ID NO: 1462 - DNA, 21 bp, Artificial Sequence
  Description of Artificial Sequence: Synthetic oligonucleotide
  Description of Combined DNA/RNA Molecule: Synthetic oligonucleotide
cacuggaugcucuccacgutt

SEQ ID NO: 1463 - DNA, 21 bp, Artificial Sequence
  Description of Artificial Sequence: Synthetic oligonucleotide
  Description of Combined DNA/RNA Molecule: Synthetic oligonucleotide
cguggagagcauccaguggtt

SEQ ID NO: 1464 - DNA, 21 bp, Artificial Sequence
  Description of Artificial Sequence: Synthetic oligonucleotide
  Description of Combined DNA/RNA Molecule: Synthetic oligonucleotide
ccacuggaugcucuccacgtt

SEQ ID NO: 1465 - DNA, 21 bp, Artificial Sequence
  Description of Artificial Sequence: Synthetic oligonucleotide
  Description of Combined DNA/RNA Molecule: Synthetic oligonucleotide
guggagagcauccaguggctt

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
gccacuggaugcucuccactt

SEQ ID NO: 1467 - DNA, 21 bp, Artificial Sequence
  Description of Artificial Sequence: Synthetic oligonucleotide
  Description of Combined DNA/RNA Molecule: Synthetic oligonucleotide
gagagcauccaguggcgggtt

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
cccgccacuggaugcucuctt

SEQ ID NO: 1469 - DNA, 21 bp, Artificial Sequence
  Description of Artificial Sequence: Synthetic oligonucleotide
  Description of Combined DNA/RNA Molecule: Synthetic oligonucleotide
agagcauccaguggcgggatt

SEQ ID NO: 1470 - DNA, 21 bp, Artificial Sequence
  Description of Artificial Sequence: Synthetic oligonucleotide
  Description of Combined DNA/RNA Molecule: Synthetic oligonucleotide
ucccgccacuggaugcucutt

SEQ ID NO: 1471 - DNA, 21 bp, Artificial Sequence
  Description of Artificial Sequence: Synthetic oligonucleotide
  Description of Combined DNA/RNA Molecule: Synthetic oligonucleotide
gagcauccaguggcgggactt

SEQ ID NO: 1472 - DNA, 21 bp, Artificial Sequence
  Description of Artificial Sequence: Synthetic oligonucleotide
  Description of Combined DNA/RNA Molecule: Synthetic oligonucleotide
gucccgccacuggaugcuctt

SEQ ID NO: 1473 - DNA, 21 bp, Artificial Sequence
  Description of Artificial Sequence: Synthetic oligonucleotide
  Description of Combined DNA/RNA Molecule: Synthetic oligonucleotide
caguggcgggacauagucatt

SEQ ID NO: 1474 - DNA, 21 bp, Artificial Sequence
  Description of Artificial Sequence: Synthetic oligonucleotide
  Description of Combined DNA/RNA Molecule: Synthetic oligonucleotide
ugacuaugucccgccacugtt

SEQ ID NO: 1475 - DNA, 21 bp, Artificial Sequence
  Description of Artificial Sequence: Synthetic oligonucleotide
  Description of Combined DNA/RNA Molecule: Synthetic oligonucleotide
aguggcgggacauagucagtt

SEQ ID NO: 1476 - DNA, 21 bp, Artificial Sequence
  Description of Artificial Sequence: Synthetic oligonucleotide
  Description of Combined DNA/RNA Molecule: Synthetic oligonucleotide
cugacuaugucccgccacutt

SEQ ID NO: 1477 - DNA, 21 bp, Artificial Sequence
  Description of Artificial Sequence: Synthetic oligonucleotide
  Description of Combined DNA/RNA Molecule: Synthetic oligonucleotide
uggcgggacauagucagcatt

SEQ ID NO: 1478 - DNA, 21 bp, Artificial Sequence
  Description of Artificial Sequence: Synthetic oligonucleotide
  Description of Combined DNA/RNA Molecule: Synthetic oligonucleotide
ugcugacuaugucccgccatt

SEQ ID NO: 1479 - DNA, 21 bp, Artificial Sequence
  Description of Artificial Sequence: Synthetic oligonucleotide
  Description of Combined DNA/RNA Molecule: Synthetic oligonucleotide
ggcgggacauagucagcagtt

SEQ ID NO: 1480 - DNA, 21 bp, Artificial Sequence
  Description of Artificial Sequence: Synthetic oligonucleotide
  Description of Combined DNA/RNA Molecule: Synthetic oligonucleotide
cugcugacuaugucccgcctt

SEQ ID NO: 1481 - DNA, 21 bp, Artificial Sequence
  Description of Artificial Sequence: Synthetic oligonucleotide
  Description of Combined DNA/RNA Molecule: Synthetic oligonucleotide
cucagcaacaugucgauggtt

SEQ ID NO: 1482 - DNA, 21 bp, Artificial Sequence
  Description of Artificial Sequence: Synthetic oligonucleotide
  Description of Combined DNA/RNA Molecule: Synthetic oligonucleotide
ccaucgacauguugcugagtt

SEQ ID NO: 1483 - DNA, 21 bp, Artificial Sequence
  Description of Artificial Sequence: Synthetic oligonucleotide
  Description of Combined DNA/RNA Molecule: Synthetic oligonucleotide
cagcaacaugucgauggactt

SEQ ID NO: 1484 - DNA, 21 bp, Artificial Sequence
  Description of Artificial Sequence: Synthetic oligonucleotide
  Description of Combined DNA/RNA Molecule: Synthetic oligonucleotide
guccaucgacauguugcugtt

SEQ ID NO: 1485 - DNA, 21 bp, Artificial Sequence
  Description of Artificial Sequence: Synthetic oligonucleotide
  Description of Combined DNA/RNA Molecule: Synthetic oligonucleotide
agcaacaugucgauggacutt

SEQ ID NO: 1486 - DNA, 21 bp, Artificial Sequence
  Description of Artificial Sequence: Synthetic oligonucleotide
  Description of Combined DNA/RNA Molecule: Synthetic oligonucleotide
aguccaucgacauguugcutt

SEQ ID NO: 1487 - DNA, 21 bp, Artificial Sequence
  Description of Artificial Sequence: Synthetic oligonucleotide
  Description of Combined DNA/RNA Molecule: Synthetic oligonucleotide
gcaacaugucgauggacuutt

SEQ ID NO: 1488 - DNA, 21 bp, Artificial Sequence
  Description of Artificial Sequence: Synthetic oligonucleotide
  Description of Combined DNA/RNA Molecule: Synthetic oligonucleotide
aaguccaucgacauguugctt

SEQ ID NO: 1489 - DNA, 21 bp, Artificial Sequence
  Description of Artificial Sequence: Synthetic oligonucleotide
  Description of Combined DNA/RNA Molecule: Synthetic oligonucleotide
aacaugucgauggacuucctt

SEQ ID NO: 1490 - DNA, 21 bp, Artificial Sequence
  Description of Artificial Sequence: Synthetic oligonucleotide
  Description of Combined DNA/RNA Molecule: Synthetic oligonucleotide
ggaaguccaucgacauguutt

SEQ ID NO: 1491 - DNA, 21 bp, Artificial Sequence
  Description of Artificial Sequence: Synthetic oligonucleotide
  Description of Combined DNA/RNA Molecule: Synthetic oligonucleotide
acaugucgauggacuuccatt

SEQ ID NO: 1492 - DNA, 21 bp, Artificial Sequence
  Description of Artificial Sequence: Synthetic oligonucleotide
  Description of Combined DNA/RNA Molecule: Synthetic oligonucleotide
uggaaguccaucgacaugutt

SEQ ID NO: 1493 - DNA, 21 bp, Artificial Sequence
  Description of Artificial Sequence: Synthetic oligonucleotide
  Description of Combined DNA/RNA Molecule: Synthetic oligonucleotide
caugucgauggacuuccagtt

SEQ ID NO: 1494 - DNA, 21 bp, Artificial Sequence
  Description of Artificial Sequence: Synthetic oligonucleotide
  Description of Combined DNA/RNA Molecule: Synthetic oligonucleotide
cuggaaguccaucgacaugtt

SEQ ID NO: 1495 - DNA, 21 bp, Artificial Sequence
  Description of Artificial Sequence: Synthetic oligonucleotide
  Description of Combined DNA/RNA Molecule: Synthetic oligonucleotide
augucgauggacuuccagatt

SEQ ID NO: 1496 - DNA, 21 bp, Artificial Sequence
  Description of Artificial Sequence: Synthetic oligonucleotide
  Description of Combined DNA/RNA Molecule: Synthetic oligonucleotide
ucuggaaguccaucgacautt

SEQ ID NO: 1497 - DNA, 21 bp, Artificial Sequence
  Description of Artificial Sequence: Synthetic oligonucleotide
  Description of Combined DNA/RNA Molecule: Synthetic oligonucleotide
ucgauggacuuccagaacctt

SEQ ID NO: 1498 - DNA, 21 bp, Artificial Sequence
  Description of Artificial Sequence: Synthetic oligonucleotide
  Description of Combined DNA/RNA Molecule: Synthetic oligonucleotide
gguucuggaaguccaucgatt

SEQ ID NO: 1499 - DNA, 21 bp, Artificial Sequence
  Description of Artificial Sequence: Synthetic oligonucleotide
  Description of Combined DNA/RNA Molecule: Synthetic oligonucleotide
gaaccaccugggcagcugctt

SEQ ID NO: 1500 - DNA, 21 bp, Artificial Sequence
  Description of Artificial Sequence: Synthetic oligonucleotide
  Description of Combined DNA/RNA Molecule: Synthetic oligonucleotide
gcagcugcccaggugguuctt

SEQ ID NO: 1501 - DNA, 21 bp, Artificial Sequence
  Description of Artificial Sequence: Synthetic oligonucleotide
  Description of Combined DNA/RNA Molecule: Synthetic oligonucleotide
gggcagcugccaaaagugutt

SEQ ID NO: 1502 - DNA, 21 bp, Artificial Sequence
  Description of Artificial Sequence: Synthetic oligonucleotide
  Description of Combined DNA/RNA Molecule: Synthetic oligonucleotide
acacuuuuggcagcugccctt

SEQ ID NO: 1503 - DNA, 21 bp, Artificial Sequence
  Description of Artificial Sequence: Synthetic oligonucleotide
  Description of Combined DNA/RNA Molecule: Synthetic oligonucleotide
gcagcugccaaaagugugatt

SEQ ID NO: 1504 - DNA, 21 bp, Artificial Sequence
  Description of Artificial Sequence: Synthetic oligonucleotide
  Description of Combined DNA/RNA Molecule: Synthetic oligonucleotide
ucacacuuuuggcagcugctt

SEQ ID NO: 1505 - DNA, 21 bp, Artificial Sequence
  Description of Artificial Sequence: Synthetic oligonucleotide
  Description of Combined DNA/RNA Molecule: Synthetic oligonucleotide
ugccaaaagugugauccaatt

SEQ ID NO: 1506 - DNA, 21 bp, Artificial Sequence
  Description of Artificial Sequence: Synthetic oligonucleotide
  Description of Combined DNA/RNA Molecule: Synthetic oligonucleotide
uuggaucacacuuuuggcatt

SEQ ID NO: 1507 - DNA, 21 bp, Artificial Sequence
  Description of Artificial Sequence: Synthetic oligonucleotide
  Description of Combined DNA/RNA Molecule: Synthetic oligonucleotide
gccaaaagugugauccaagtt

SEQ ID NO: 1508 - DNA, 21 bp, Artificial Sequence
  Description of Artificial Sequence: Synthetic oligonucleotide
  Description of Combined DNA/RNA Molecule: Synthetic oligonucleotide
cuuggaucacacuuuuggctt

SEQ ID NO: 1509 - DNA, 21 bp, Artificial Sequence
  Description of Artificial Sequence: Synthetic oligonucleotide
  Description of Combined DNA/RNA Molecule: Synthetic oligonucleotide
ccaaaagugugauccaagctt

SEQ ID NO: 1510 - DNA, 21 bp, Artificial Sequence
  Description of Artificial Sequence: Synthetic oligonucleotide
  Description of Combined DNA/RNA Molecule: Synthetic oligonucleotide
gcuuggaucacacuuuuggtt

SEQ ID NO: 1511 - DNA, 21 bp, Artificial Sequence
  Description of Artificial Sequence: Synthetic oligonucleotide
  Description of Combined DNA/RNA Molecule: Synthetic oligonucleotide
aaagugugauccaagcugutt

SEQ ID NO: 1512 - DNA, 21 bp, Artificial Sequence
  Description of Artificial Sequence: Synthetic oligonucleotide
  Description of Combined DNA/RNA Molecule: Synthetic oligonucleotide
acagcuuggaucacacuuutt

SEQ ID NO: 1513 - DNA, 21 bp, Artificial Sequence
  Description of Artificial Sequence: Synthetic oligonucleotide
  Description of Combined DNA/RNA Molecule: Synthetic oligonucleotide
ugugauccaagcugucccatt

SEQ ID NO: 1514 - DNA, 21 bp, Artificial Sequence
  Description of Artificial Sequence: Synthetic oligonucleotide
  Description of Combined DNA/RNA Molecule: Synthetic oligonucleotide
ugggacagcuuggaucacatt

SEQ ID NO: 1515 - DNA, 21 bp, Artificial Sequence
  Description of Artificial Sequence: Synthetic oligonucleotide
  Description of Combined DNA/RNA Molecule: Synthetic oligonucleotide
gugauccaagcugucccaatt

SEQ ID NO: 1516 - DNA, 21 bp, Artificial Sequence
  Description of Artificial Sequence: Synthetic oligonucleotide
  Description of Combined DNA/RNA Molecule: Synthetic oligonucleotide
uugggacagcuuggaucactt

SEQ ID NO: 1517 - DNA, 21 bp, Artificial Sequence
  Description of Artificial Sequence: Synthetic oligonucleotide
  Description of Combined DNA/RNA Molecule: Synthetic oligonucleotide
gauccaagcugucccaaugtt

SEQ ID NO: 1518 - DNA, 21 bp, Artificial Sequence
  Description of Artificial Sequence: Synthetic oligonucleotide
  Description of Combined DNA/RNA Molecule: Synthetic oligonucleotide
cauugggacagcuuggauctt

SEQ ID NO: 1519 - DNA, 21 bp, Artificial Sequence
  Description of Artificial Sequence: Synthetic oligonucleotide
  Description of Combined DNA/RNA Molecule: Synthetic oligonucleotide
auccaagcugucccaauggtt

SEQ ID NO: 1520 - DNA, 21 bp, Artificial Sequence
  Description of Artificial Sequence: Synthetic oligonucleotide
  Description of Combined DNA/RNA Molecule: Synthetic oligonucleotide
ccauugggacagcuuggautt

SEQ ID NO: 1521 - DNA, 21 bp, Artificial Sequence
  Description of Artificial Sequence: Synthetic oligonucleotide
  Description of Combined DNA/RNA Molecule: Synthetic oligonucleotide
uccaagcugucccaaugggtt

SEQ ID NO: 1522 - DNA, 21 bp, Artificial Sequence
  Description of Artificial Sequence: Synthetic oligonucleotide
  Description of Combined DNA/RNA Molecule: Synthetic oligonucleotide
cccauugggacagcuuggatt

SEQ ID NO: 1523 - DNA, 21 bp, Artificial Sequence
  Description of Artificial Sequence: Synthetic oligonucleotide
  Description of Combined DNA/RNA Molecule: Synthetic oligonucleotide
ccaagcugucccaaugggatt

SEQ ID NO: 1524 - DNA, 21 bp, Artificial Sequence
  Description of Artificial Sequence: Synthetic oligonucleotide
  Description of Combined DNA/RNA Molecule: Synthetic oligonucleotide
ucccauugggacagcuuggtt

SEQ ID NO: 1525 - DNA, 21 bp, Artificial Sequence
  Description of Artificial Sequence: Synthetic oligonucleotide
  Description of Combined DNA/RNA Molecule: Synthetic oligonucleotide
caagcugucccaaugggagtt

SEQ ID NO: 1526 - DNA, 21 bp, Artificial Sequence
  Description of Artificial Sequence: Synthetic oligonucleotide
  Description of Combined DNA/RNA Molecule: Synthetic oligonucleotide
cucccauugggacagcuugtt

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
agcugucccaaugggagcutt

SEQ ID NO: 1528 - DNA, 21 bp, Artificial Sequence
  Description of Artificial Sequence: Synthetic oligonucleotide
  Description of Combined DNA/RNA Molecule: Synthetic oligonucleotide
agcucccauugggacagcutt

SEQ ID NO: 1529 - DNA, 21 bp, Artificial Sequence
  Description of Artificial Sequence: Synthetic oligonucleotide
  Description of Combined DNA/RNA Molecule: Synthetic oligonucleotide
ugucccaaugggagcugcutt

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
agcagcucccauugggacatt

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
ggugcaggagaggagaacutt

SEQ ID NO: 1532 - DNA, 21 bp, Artificial Sequence
  Description of Artificial Sequence: Synthetic oligonucleotide
  Description of Combined DNA/RNA Molecule: Synthetic oligonucleotide
aguucuccucuccugcacctt

SEQ ID NO: 1533 - DNA, 21 bp, Artificial Sequence
  Description of Artificial Sequence: Synthetic oligonucleotide
  Description of Combined DNA/RNA Molecule: Synthetic oligonucleotide
aaacugaccaaaaucaucutt

SEQ ID NO: 1534 - DNA, 21 bp, Artificial Sequence
  Description of Artificial Sequence: Synthetic oligonucleotide
  Description of Combined DNA/RNA Molecule: Synthetic oligonucleotide
agaugauuuuggucaguuutt

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
aacugaccaaaaucaucugtt

SEQ ID NO: 1536 - DNA, 21 bp, Artificial Sequence
  Description of Artificial Sequence: Synthetic oligonucleotide
  Description of Combined DNA/RNA Molecule: Synthetic oligonucleotide
cagaugauuuuggucaguutt

SEQ ID NO: 1537 - DNA, 21 bp, Artificial Sequence
  Description of Artificial Sequence: Synthetic oligonucleotide
  Description of Combined DNA/RNA Molecule: Synthetic oligonucleotide
acugaccaaaaucaucugutt

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
acagaugauuuuggucagutt

SEQ ID NO: 1539 - DNA, 21 bp, Artificial Sequence
  Description of Artificial Sequence: Synthetic oligonucleotide
  Description of Combined DNA/RNA Molecule: Synthetic oligonucleotide
accaaaaucaucugugccctt

SEQ ID NO: 1540 - DNA, 21 bp, Artificial Sequence
  Description of Artificial Sequence: Synthetic oligonucleotide
  Description of Combined DNA/RNA Molecule: Synthetic oligonucleotide
gggcacagaugauuuuggutt

SEQ ID NO: 1541 - DNA, 21 bp, Artificial Sequence
  Description of Artificial Sequence: Synthetic oligonucleotide
  Description of Combined DNA/RNA Molecule: Synthetic oligonucleotide
ccaaaaucaucugugcccatt

SEQ ID NO: 1542 - DNA, 21 bp, Artificial Sequence
  Description of Artificial Sequence: Synthetic oligonucleotide
  Description of Combined DNA/RNA Molecule: Synthetic oligonucleotide
ugggcacagaugauuuuggtt

SEQ ID NO: 1543 - DNA, 21 bp, Artificial Sequence
  Description of Artificial Sequence: Synthetic oligonucleotide
  Description of Combined DNA/RNA Molecule: Synthetic oligonucleotide
aaaucaucugugcccagcatt

SEQ ID NO: 1544 - DNA, 21 bp, Artificial Sequence
  Description of Artificial Sequence: Synthetic oligonucleotide
  Description of Combined DNA/RNA Molecule: Synthetic oligonucleotide
ugcugggcacagaugauuutt

SEQ ID NO: 1545 - DNA, 21 bp, Artificial Sequence
  Description of Artificial Sequence: Synthetic oligonucleotide
  Description of Combined DNA/RNA Molecule: Synthetic oligonucleotide
gugcccagcagugcuccggtt

SEQ ID NO: 1546 - DNA, 21 bp, Artificial Sequence
  Description of Artificial Sequence: Synthetic oligonucleotide
  Description of Combined DNA/RNA Molecule: Synthetic oligonucleotide
ccggagcacugcugggcactt

SEQ ID NO: 1547 - DNA, 21 bp, Artificial Sequence
  Description of Artificial Sequence: Synthetic oligonucleotide
  Description of Combined DNA/RNA Molecule: Synthetic oligonucleotide
gcccagcagugcuccgggctt

SEQ ID NO: 1548 - DNA, 21 bp, Artificial Sequence
  Description of Artificial Sequence: Synthetic oligonucleotide
  Description of Combined DNA/RNA Molecule: Synthetic oligonucleotide
gcccggagcacugcugggctt

SEQ ID NO: 1549 - DNA, 21 bp, Artificial Sequence
  Description of Artificial Sequence: Synthetic oligonucleotide
  Description of Combined DNA/RNA Molecule: Synthetic oligonucleotide
ccagugacugcugccacaatt

SEQ ID NO: 1550 - DNA, 21 bp, Artificial Sequence
  Description of Artificial Sequence: Synthetic oligonucleotide
  Description of Combined DNA/RNA Molecule: Synthetic oligonucleotide
uuguggcagcagucacuggtt

SEQ ID NO: 1551 - DNA, 21 bp, Artificial Sequence
  Description of Artificial Sequence: Synthetic oligonucleotide
  Description of Combined DNA/RNA Molecule: Synthetic oligonucleotide
cagugacugcugccacaactt

SEQ ID NO: 1552 - DNA, 21 bp, Artificial Sequence
  Description of Artificial Sequence: Synthetic oligonucleotide
  Description of Combined DNA/RNA Molecule: Synthetic oligonucleotide
guuguggcagcagucacugtt

SEQ ID NO: 1553 - DNA, 21 bp, Artificial Sequence
  Description of Artificial Sequence: Synthetic oligonucleotide
  Description of Combined DNA/RNA Molecule: Synthetic oligonucleotide
gagagcgacugccuggucutt

SEQ ID NO: 1554 - DNA, 21 bp, Artificial Sequence
  Description of Artificial Sequence: Synthetic oligonucleotide
  Description of Combined DNA/RNA Molecule: Synthetic oligonucleotide
agaccaggcagucgcucuctt

SEQ ID NO: 1555 - DNA, 21 bp, Artificial Sequence
  Description of Artificial Sequence: Synthetic oligonucleotide
  Description of Combined DNA/RNA Molecule: Synthetic oligonucleotide
agagcgacugccuggucugtt

SEQ ID NO: 1556 - DNA, 21 bp, Artificial Sequence
  Description of Artificial Sequence: Synthetic oligonucleotide
  Description of Combined DNA/RNA Molecule: Synthetic oligonucleotide
cagaccaggcagucgcucutt

SEQ ID NO: 1557 - DNA, 21 bp, Artificial Sequence
  Description of Artificial Sequence: Synthetic oligonucleotide
  Description of Combined DNA/RNA Molecule: Synthetic oligonucleotide
gagcgacugccuggucugctt

SEQ ID NO: 1558 - DNA, 21 bp, Artificial Sequence
  Description of Artificial Sequence: Synthetic oligonucleotide
  Description of Combined DNA/RNA Molecule: Synthetic oligonucleotide
gcagaccaggcagucgcuctt

SEQ ID NO: 1559 - DNA, 21 bp, Artificial Sequence
  Description of Artificial Sequence: Synthetic oligonucleotide
  Description of Combined DNA/RNA Molecule: Synthetic oligonucleotide
agcgacugccuggucugcctt

SEQ ID NO: 1560 - DNA, 21 bp, Artificial Sequence
  Description of Artificial Sequence: Synthetic oligonucleotide
  Description of Combined DNA/RNA Molecule: Synthetic oligonucleotide
ggcagaccaggcagucgcutt

SEQ ID NO: 1561 - DNA, 21 bp, Artificial Sequence
  Description of Artificial Sequence: Synthetic oligonucleotide
  Description of Combined DNA/RNA Molecule: Synthetic oligonucleotide
gcgacugccuggucugccgtt

SEQ ID NO: 1562 - DNA, 21 bp, Artificial Sequence
  Description of Artificial Sequence: Synthetic oligonucleotide
  Description of Combined DNA/RNA Molecule: Synthetic oligonucleotide
cggcagaccaggcagucgctt

SEQ ID NO: 1563 - DNA, 21 bp, Artificial Sequence
  Description of Artificial Sequence: Synthetic oligonucleotide
  Description of Combined DNA/RNA Molecule: Synthetic oligonucleotide
cgacugccuggucugccgctt

SEQ ID NO: 1564 - DNA, 21 bp, Artificial Sequence
  Description of Artificial Sequence: Synthetic oligonucleotide
  Description of Combined DNA/RNA Molecule: Synthetic oligonucleotide
gcggcagaccaggcagucgtt

SEQ ID NO: 1565 - DNA, 21 bp, Artificial Sequence
  Description of Artificial Sequence: Synthetic oligonucleotide
  Description of Combined DNA/RNA Molecule: Synthetic oligonucleotide
gccuggucugccgcaaauutt

SEQ ID NO: 1566 - DNA, 21 bp, Artificial Sequence
  Description of Artificial Sequence: Synthetic oligonucleotide
  Description of Combined DNA/RNA Molecule: Synthetic oligonucleotide
aauuugcggcagaccaggctt

SEQ ID NO: 1567 - DNA, 21 bp, Artificial Sequence
  Description of Artificial Sequence: Synthetic oligonucleotide
  Description of Combined DNA/RNA Molecule: Synthetic oligonucleotide
ccuggucugccgcaaauuctt

SEQ ID NO: 1568 - DNA, 21 bp, Artificial Sequence
  Description of Artificial Sequence: Synthetic oligonucleotide
  Description of Combined DNA/RNA Molecule: Synthetic oligonucleotide
gaauuugcggcagaccaggtt

SEQ ID NO: 1569 - DNA, 21 bp, Artificial Sequence
  Description of Artificial Sequence: Synthetic oligonucleotide
  Description of Combined DNA/RNA Molecule: Synthetic oligonucleotide
cuggucugccgcaaauucctt

SEQ ID NO: 1570 - DNA, 21 bp, Artificial Sequence
  Description of Artificial Sequence: Synthetic oligonucleotide
  Description of Combined DNA/RNA Molecule: Synthetic oligonucleotide
ggaauuugcggcagaccagtt

SEQ ID NO: 1571 - DNA, 21 bp, Artificial Sequence
  Description of Artificial Sequence: Synthetic oligonucleotide
  Description of Combined DNA/RNA Molecule: Synthetic oligonucleotide
uggucugccgcaaauuccgtt

SEQ ID NO: 1572 - DNA, 21 bp, Artificial Sequence
  Description of Artificial Sequence: Synthetic oligonucleotide
  Description of Combined DNA/RNA Molecule: Synthetic oligonucleotide
cggaauuugcggcagaccatt

SEQ ID NO: 1573 - DNA, 21 bp, Artificial Sequence
  Description of Artificial Sequence: Synthetic oligonucleotide
  Description of Combined DNA/RNA Molecule: Synthetic oligonucleotide
gucugccgcaaauuccgagtt

SEQ ID NO: 1574 - DNA, 21 bp, Artificial Sequence
  Description of Artificial Sequence: Synthetic oligonucleotide
  Description of Combined DNA/RNA Molecule: Synthetic oligonucleotide
cucggaauuugcggcagactt

SEQ ID NO: 1575 - DNA, 21 bp, Artificial Sequence
  Description of Artificial Sequence: Synthetic oligonucleotide
  Description of Combined DNA/RNA Molecule: Synthetic oligonucleotide
ucugccgcaaauuccgagatt

SEQ ID NO: 1576 - DNA, 21 bp, Artificial Sequence
  Description of Artificial Sequence: Synthetic oligonucleotide
  Description of Combined DNA/RNA Molecule: Synthetic oligonucleotide
ucucggaauuugcggcagatt

SEQ ID NO: 1577 - DNA, 21 bp, Artificial Sequence
  Description of Artificial Sequence: Synthetic oligonucleotide
  Description of Combined DNA/RNA Molecule: Synthetic oligonucleotide
cugccgcaaauuccgagactt

SEQ ID NO: 1578 - DNA, 21 bp, Artificial Sequence
  Description of Artificial Sequence: Synthetic oligonucleotide
  Description of Combined DNA/RNA Molecule: Synthetic oligonucleotide
gucucggaauuugcggcagtt

SEQ ID NO: 1579 - DNA, 21 bp, Artificial Sequence
  Description of Artificial Sequence: Synthetic oligonucleotide
  Description of Combined DNA/RNA Molecule: Synthetic oligonucleotide
ugccgcaaauuccgagacgtt

SEQ ID NO: 1580 - DNA, 21 bp, Artificial Sequence
  Description of Artificial Sequence: Synthetic oligonucleotide
  Description of Combined DNA/RNA Molecule: Synthetic oligonucleotide
cgucucggaauuugcggcatt

SEQ ID NO: 1581 - DNA, 21 bp, Artificial Sequence
  Description of Artificial Sequence: Synthetic oligonucleotide
  Description of Combined DNA/RNA Molecule: Synthetic oligonucleotide
ccgcaaauuccgagacgaatt

SEQ ID NO: 1582 - DNA, 21 bp, Artificial Sequence
  Description of Artificial Sequence: Synthetic oligonucleotide
  Description of Combined DNA/RNA Molecule: Synthetic oligonucleotide
uucgucucggaauuugcggtt

SEQ ID NO: 1583 - DNA, 21 bp, Artificial Sequence
  Description of Artificial Sequence: Synthetic oligonucleotide
  Description of Combined DNA/RNA Molecule: Synthetic oligonucleotide
aauuccgagacgaagccactt

SEQ ID NO: 1584 - DNA, 21 bp, Artificial Sequence
  Description of Artificial Sequence: Synthetic oligonucleotide
  Description of Combined DNA/RNA Molecule: Synthetic oligonucleotide
guggcuucgucucggaauutt

SEQ ID NO: 1585 - DNA, 21 bp, Artificial Sequence
  Description of Artificial Sequence: Synthetic oligonucleotide
  Description of Combined DNA/RNA Molecule: Synthetic oligonucleotide
auuccgagacgaagccacgtt

SEQ ID NO: 1586 - DNA, 21 bp, Artificial Sequence
  Description of Artificial Sequence: Synthetic oligonucleotide
  Description of Combined DNA/RNA Molecule: Synthetic oligonucleotide
cguggcuucgucucggaautt

SEQ ID NO: 1587 - DNA, 21 bp, Artificial Sequence
  Description of Artificial Sequence: Synthetic oligonucleotide
  Description of Combined DNA/RNA Molecule: Synthetic oligonucleotide
uuccgagacgaagccacgutt

SEQ ID NO: 1588 - DNA, 21 bp, Artificial Sequence
  Description of Artificial Sequence: Synthetic oligonucleotide
  Description of Combined DNA/RNA Molecule: Synthetic oligonucleotide
acguggcuucgucucggaatt

SEQ ID NO: 1589 - DNA, 21 bp, Artificial Sequence
  Description of Artificial Sequence: Synthetic oligonucleotide
  Description of Combined DNA/RNA Molecule: Synthetic oligonucleotide
uccgagacgaagccacgugtt

SEQ ID NO: 1590 - DNA, 21 bp, Artificial Sequence
  Description of Artificial Sequence: Synthetic oligonucleotide
  Description of Combined DNA/RNA Molecule: Synthetic oligonucleotide
cacguggcuucgucucggatt

SEQ ID NO: 1591 - DNA, 21 bp, Artificial Sequence
  Description of Artificial Sequence: Synthetic oligonucleotide
  Description of Combined DNA/RNA Molecule: Synthetic oligonucleotide
ccgagacgaagccacgugctt

SEQ ID NO: 1592 - DNA, 21 bp, Artificial Sequence
  Description of Artificial Sequence: Synthetic oligonucleotide
  Description of Combined DNA/RNA Molecule: Synthetic oligonucleotide
gcacguggcuucgucucggtt

SEQ ID NO: 1593 - DNA, 21 bp, Artificial Sequence
  Description of Artificial Sequence: Synthetic oligonucleotide
  Description of Combined DNA/RNA Molecule: Synthetic oligonucleotide
gagacgaagccacgugcaatt

SEQ ID NO: 1594 - DNA, 21 bp, Artificial Sequence
  Description of Artificial Sequence: Synthetic oligonucleotide
  Description of Combined DNA/RNA Molecule: Synthetic oligonucleotide
uugcacguggcuucgucuctt

SEQ ID NO: 1595 - DNA, 21 bp, Artificial Sequence
  Description of Artificial Sequence: Synthetic oligonucleotide
  Description of Combined DNA/RNA Molecule: Synthetic oligonucleotide
acgaagccacgugcaaggatt

SEQ ID NO: 1596 - DNA, 21 bp, Artificial Sequence
  Description of Artificial Sequence: Synthetic oligonucleotide
  Description of Combined DNA/RNA Molecule: Synthetic oligonucleotide
uccuugcacguggcuucgutt

SEQ ID NO: 1597 - DNA, 21 bp, Artificial Sequence
  Description of Artificial Sequence: Synthetic oligonucleotide
  Description of Combined DNA/RNA Molecule: Synthetic oligonucleotide
cgaagccacgugcaaggactt

SEQ ID NO: 1598 - DNA, 21 bp, Artificial Sequence
  Description of Artificial Sequence: Synthetic oligonucleotide
  Description of Combined DNA/RNA Molecule: Synthetic oligonucleotide
guccuugcacguggcuucgtt

SEQ ID NO: 1599 - DNA, 21 bp, Artificial Sequence
  Description of Artificial Sequence: Synthetic oligonucleotide
  Description of Combined DNA/RNA Molecule: Synthetic oligonucleotide
gaagccacgugcaaggacatt

SEQ ID NO: 1600 - DNA, 21 bp, Artificial Sequence
  Description of Artificial Sequence: Synthetic oligonucleotide
  Description of Combined DNA/RNA Molecule: Synthetic oligonucleotide
uguccuugcacguggcuuctt

SEQ ID NO: 1601 - DNA, 21 bp, Artificial Sequence
  Description of Artificial Sequence: Synthetic oligonucleotide
  Description of Combined DNA/RNA Molecule: Synthetic oligonucleotide
aagccacgugcaaggacactt

SEQ ID NO: 1602 - DNA, 21 bp, Artificial Sequence
  Description of Artificial Sequence: Synthetic oligonucleotide
  Description of Combined DNA/RNA Molecule: Synthetic oligonucleotide
guguccuugcacguggcuutt

SEQ ID NO: 1603 - DNA, 21 bp, Artificial Sequence
  Description of Artificial Sequence: Synthetic oligonucleotide
  Description of Combined DNA/RNA Molecule: Synthetic oligonucleotide
ccccacucaugcucuacaatt

SEQ ID NO: 1604 - DNA, 21 bp, Artificial Sequence
  Description of Artificial Sequence: Synthetic oligonucleotide
  Description of Combined DNA/RNA Molecule: Synthetic oligonucleotide
uuguagagcaugaguggggtt

SEQ ID NO: 1605 - DNA, 21 bp, Artificial Sequence
  Description of Artificial Sequence: Synthetic oligonucleotide
  Description of Combined DNA/RNA Molecule: Synthetic oligonucleotide
ccacucaugcucuacaacctt

SEQ ID NO: 1606 - DNA, 21 bp, Artificial Sequence
  Description of Artificial Sequence: Synthetic oligonucleotide
  Description of Combined DNA/RNA Molecule: Synthetic oligonucleotide
gguuguagagcaugaguggtt

SEQ ID NO: 1607 - DNA, 21 bp, Artificial Sequence
  Description of Artificial Sequence: Synthetic oligonucleotide
  Description of Combined DNA/RNA Molecule: Synthetic oligonucleotide
acucaugcucuacaacccctt

SEQ ID NO: 1608 - DNA, 21 bp, Artificial Sequence
  Description of Artificial Sequence: Synthetic oligonucleotide
  Description of Combined DNA/RNA Molecule: Synthetic oligonucleotide
gggguuguagagcaugagutt

SEQ ID NO: 1609 - DNA, 21 bp, Artificial Sequence
  Description of Artificial Sequence: Synthetic oligonucleotide
  Description of Combined DNA/RNA Molecule: Synthetic oligonucleotide
caugcucuacaaccccacctt

SEQ ID NO: 1610 - DNA, 21 bp, Artificial Sequence
  Description of Artificial Sequence: Synthetic oligonucleotide
  Description of Combined DNA/RNA Molecule: Synthetic oligonucleotide
ggugggguuguagagcaugtt

SEQ ID NO: 1611 - DNA, 21 bp, Artificial Sequence
  Description of Artificial Sequence: Synthetic oligonucleotide
  Description of Combined DNA/RNA Molecule: Synthetic oligonucleotide
ccagauggaugugaacccctt

SEQ ID NO: 1612 - DNA, 21 bp, Artificial Sequence
  Description of Artificial Sequence: Synthetic oligonucleotide
  Description of Combined DNA/RNA Molecule: Synthetic oligonucleotide
gggguucacauccaucuggtt

SEQ ID NO: 1613 - DNA, 21 bp, Artificial Sequence
  Description of Artificial Sequence: Synthetic oligonucleotide
  Description of Combined DNA/RNA Molecule: Synthetic oligonucleotide
agauggaugugaaccccgatt

SEQ ID NO: 1614 - DNA, 21 bp, Artificial Sequence
  Description of Artificial Sequence: Synthetic oligonucleotide
  Description of Combined DNA/RNA Molecule: Synthetic oligonucleotide
ucgggguucacauccaucutt

SEQ ID NO: 1615 - DNA, 21 bp, Artificial Sequence
  Description of Artificial Sequence: Synthetic oligonucleotide
  Description of Combined DNA/RNA Molecule: Synthetic oligonucleotide
gauggaugugaaccccgagtt

SEQ ID NO: 1616 - DNA, 21 bp, Artificial Sequence
  Description of Artificial Sequence: Synthetic oligonucleotide
  Description of Combined DNA/RNA Molecule: Synthetic oligonucleotide
cucgggguucacauccauctt

SEQ ID NO: 1617 - DNA, 21 bp, Artificial Sequence
  Description of Artificial Sequence: Synthetic oligonucleotide
  Description of Combined DNA/RNA Molecule: Synthetic oligonucleotide
auggaugugaaccccgaggtt

SEQ ID NO: 1618 - DNA, 21 bp, Artificial Sequence
  Description of Artificial Sequence: Synthetic oligonucleotide
  Description of Combined DNA/RNA Molecule: Synthetic oligonucleotide
ccucgggguucacauccautt

SEQ ID NO: 1619 - DNA, 21 bp, Artificial Sequence
  Description of Artificial Sequence: Synthetic oligonucleotide
  Description of Combined DNA/RNA Molecule: Synthetic oligonucleotide
ggaugugaaccccgagggctt

SEQ ID NO: 1620 - DNA, 21 bp, Artificial Sequence
  Description of Artificial Sequence: Synthetic oligonucleotide
  Description of Combined DNA/RNA Molecule: Synthetic oligonucleotide
gcccucgggguucacaucctt

SEQ ID NO: 1621 - DNA, 21 bp, Artificial Sequence
  Description of Artificial Sequence: Synthetic oligonucleotide
  Description of Combined DNA/RNA Molecule: Synthetic oligonucleotide
gaugugaaccccgagggcatt

SEQ ID NO: 1622 - DNA, 21 bp, Artificial Sequence
  Description of Artificial Sequence: Synthetic oligonucleotide
  Description of Combined DNA/RNA Molecule: Synthetic oligonucleotide
ugcccucgggguucacauctt

SEQ ID NO: 1623 - DNA, 21 bp, Artificial Sequence
  Description of Artificial Sequence: Synthetic oligonucleotide
  Description of Combined DNA/RNA Molecule: Synthetic oligonucleotide
ugugaaccccgagggcaaatt

SEQ ID NO: 1624 - DNA, 21 bp, Artificial Sequence
  Description of Artificial Sequence: Synthetic oligonucleotide
  Description of Combined DNA/RNA Molecule: Synthetic oligonucleotide
uuugcccucgggguucacatt

SEQ ID NO: 1625 - DNA, 21 bp, Artificial Sequence
  Description of Artificial Sequence: Synthetic oligonucleotide
  Description of Combined DNA/RNA Molecule: Synthetic oligonucleotide
aaccccgagggcaaauacatt

SEQ ID NO: 1626 - DNA, 21 bp, Artificial Sequence
  Description of Artificial Sequence: Synthetic oligonucleotide
  Description of Combined DNA/RNA Molecule: Synthetic oligonucleotide
uguauuugcccucgggguutt

SEQ ID NO: 1627 - DNA, 21 bp, Artificial Sequence
  Description of Artificial Sequence: Synthetic oligonucleotide
  Description of Combined DNA/RNA Molecule: Synthetic oligonucleotide
accccgagggcaaauacagtt

SEQ ID NO: 1628 - DNA, 21 bp, Artificial Sequence
  Description of Artificial Sequence: Synthetic oligonucleotide
  Description of Combined DNA/RNA Molecule: Synthetic oligonucleotide
cuguauuugcccucggggutt

SEQ ID NO: 1629 - DNA, 21 bp, Artificial Sequence
  Description of Artificial Sequence: Synthetic oligonucleotide
  Description of Combined DNA/RNA Molecule: Synthetic oligonucleotide
cccgagggcaaauacagcutt

SEQ ID NO: 1630 - DNA, 21 bp, Artificial Sequence
  Description of Artificial Sequence: Synthetic oligonucleotide
  Description of Combined DNA/RNA Molecule: Synthetic oligonucleotide
agcuguauuugcccucgggtt

SEQ ID NO: 1631 - DNA, 21 bp, Artificial Sequence
  Description of Artificial Sequence: Synthetic oligonucleotide
  Description of Combined DNA/RNA Molecule: Synthetic oligonucleotide
ccgagggcaaauacagcuutt

SEQ ID NO: 1632 - DNA, 21 bp, Artificial Sequence
  Description of Artificial Sequence: Synthetic oligonucleotide
  Description of Combined DNA/RNA Molecule: Synthetic oligonucleotide
aagcuguauuugcccucggtt

SEQ ID NO: 1633 - DNA, 21 bp, Artificial Sequence
  Description of Artificial Sequence: Synthetic oligonucleotide
  Description of Combined DNA/RNA Molecule: Synthetic oligonucleotide
cgagggcaaauacagcuuutt

SEQ ID NO: 1634 - DNA, 21 bp, Artificial Sequence
  Description of Artificial Sequence: Synthetic oligonucleotide
  Description of Combined DNA/RNA Molecule: Synthetic oligonucleotide
aaagcuguauuugcccucgtt

SEQ ID NO: 1635 - DNA, 21 bp, Artificial Sequence
  Description of Artificial Sequence: Synthetic oligonucleotide
  Description of Combined DNA/RNA Molecule: Synthetic oligonucleotide
aaauacagcuuuggugccatt

SEQ ID NO: 1636 - DNA, 21 bp, Artificial Sequence
  Description of Artificial Sequence: Synthetic oligonucleotide
  Description of Combined DNA/RNA Molecule: Synthetic oligonucleotide
uggcaccaaagcuguauuutt

SEQ ID NO: 1637 - DNA, 21 bp, Artificial Sequence
  Description of Artificial Sequence: Synthetic oligonucleotide
  Description of Combined DNA/RNA Molecule: Synthetic oligonucleotide
aauacagcuuuggugccactt

SEQ ID NO: 1638 - DNA, 21 bp, Artificial Sequence
  Description of Artificial Sequence: Synthetic oligonucleotide
  Description of Combined DNA/RNA Molecule: Synthetic oligonucleotide
guggcaccaaagcuguauutt

SEQ ID NO: 1639 - DNA, 21 bp, Artificial Sequence
  Description of Artificial Sequence: Synthetic oligonucleotide
  Description of Combined DNA/RNA Molecule: Synthetic oligonucleotide
auacagcuuuggugccacctt

SEQ ID NO: 1640 - DNA, 21 bp, Artificial Sequence
  Description of Artificial Sequence: Synthetic oligonucleotide
  Description of Combined DNA/RNA Molecule: Synthetic oligonucleotide
gguggcaccaaagcuguautt

SEQ ID NO: 1641 - DNA, 21 bp, Artificial Sequence
  Description of Artificial Sequence: Synthetic oligonucleotide
  Description of Combined DNA/RNA Molecule: Synthetic oligonucleotide
cuuuggugccaccugcgugtt

SEQ ID NO: 1642 - DNA, 21 bp, Artificial Sequence
  Description of Artificial Sequence: Synthetic oligonucleotide
  Description of Combined DNA/RNA Molecule: Synthetic oligonucleotide
cacgcagguggcaccaaagtt

SEQ ID NO: 1643 - DNA, 21 bp, Artificial Sequence
  Description of Artificial Sequence: Synthetic oligonucleotide
  Description of Combined DNA/RNA Molecule: Synthetic oligonucleotide
uuggugccaccugcgugaatt

SEQ ID NO: 1644 - DNA, 21 bp, Artificial Sequence
  Description of Artificial Sequence: Synthetic oligonucleotide
  Description of Combined DNA/RNA Molecule: Synthetic oligonucleotide
uucacgcagguggcaccaatt

SEQ ID NO: 1645 - DNA, 21 bp, Artificial Sequence
  Description of Artificial Sequence: Synthetic oligonucleotide
  Description of Combined DNA/RNA Molecule: Synthetic oligonucleotide
ccaccugcgugaagaagugtt

SEQ ID NO: 1646 - DNA, 21 bp, Artificial Sequence
  Description of Artificial Sequence: Synthetic oligonucleotide
  Description of Combined DNA/RNA Molecule: Synthetic oligonucleotide
cacuucuucacgcagguggtt

SEQ ID NO: 1647 - DNA, 21 bp, Artificial Sequence
  Description of Artificial Sequence: Synthetic oligonucleotide
  Description of Combined DNA/RNA Molecule: Synthetic oligonucleotide
cugcgugaagaaguguccctt

SEQ ID NO: 1648 - DNA, 21 bp, Artificial Sequence
  Description of Artificial Sequence: Synthetic oligonucleotide
  Description of Combined DNA/RNA Molecule: Synthetic oligonucleotide
gggacacuucuucacgcagtt

SEQ ID NO: 1649 - DNA, 21 bp, Artificial Sequence
  Description of Artificial Sequence: Synthetic oligonucleotide
  Description of Combined DNA/RNA Molecule: Synthetic oligonucleotide
ugcgugaagaagugucccctt

SEQ ID NO: 1650 - DNA, 21 bp, Artificial Sequence
  Description of Artificial Sequence: Synthetic oligonucleotide
  Description of Combined DNA/RNA Molecule: Synthetic oligonucleotide
ggggacacuucuucacgcatt

SEQ ID NO: 1651 - DNA, 21 bp, Artificial Sequence
  Description of Artificial Sequence: Synthetic oligonucleotide
  Description of Combined DNA/RNA Molecule: Synthetic oligonucleotide
gcgugaagaaguguccccgtt

SEQ ID NO: 1652 - DNA, 21 bp, Artificial Sequence
  Description of Artificial Sequence: Synthetic oligonucleotide
  Description of Combined DNA/RNA Molecule: Synthetic oligonucleotide
cggggacacuucuucacgctt

SEQ ID NO: 1653 - DNA, 21 bp, Artificial Sequence
  Description of Artificial Sequence: Synthetic oligonucleotide
  Description of Combined DNA/RNA Molecule: Synthetic oligonucleotide
cgugaagaaguguccccgutt

SEQ ID NO: 1654 - DNA, 21 bp, Artificial Sequence
  Description of Artificial Sequence: Synthetic oligonucleotide
  Description of Combined DNA/RNA Molecule: Synthetic oligonucleotide
acggggacacuucuucacgtt

SEQ ID NO: 1655 - DNA, 21 bp, Artificial Sequence
  Description of Artificial Sequence: Synthetic oligonucleotide
  Description of Combined DNA/RNA Molecule: Synthetic oligonucleotide
gugaagaaguguccccguatt

SEQ ID NO: 1656 - DNA, 21 bp, Artificial Sequence
  Description of Artificial Sequence: Synthetic oligonucleotide
  Description of Combined DNA/RNA Molecule: Synthetic oligonucleotide
uacggggacacuucuucactt

SEQ ID NO: 1657 - DNA, 21 bp, Artificial Sequence
  Description of Artificial Sequence: Synthetic oligonucleotide
  Description of Combined DNA/RNA Molecule: Synthetic oligonucleotide
ugaagaaguguccccguaatt

SEQ ID NO: 1658 - DNA, 21 bp, Artificial Sequence
  Description of Artificial Sequence: Synthetic oligonucleotide
  Description of Combined DNA/RNA Molecule: Synthetic oligonucleotide
uuacggggacacuucuucatt

SEQ ID NO: 1659 - DNA, 21 bp, Artificial Sequence
  Description of Artificial Sequence: Synthetic oligonucleotide
  Description of Combined DNA/RNA Molecule: Synthetic oligonucleotide
gaagaaguguccccguaautt

SEQ ID NO: 1660 - DNA, 21 bp, Artificial Sequence
  Description of Artificial Sequence: Synthetic oligonucleotide
  Description of Combined DNA/RNA Molecule: Synthetic oligonucleotide
auuacggggacacuucuuctt

SEQ ID NO: 1661 - DNA, 21 bp, Artificial Sequence
  Description of Artificial Sequence: Synthetic oligonucleotide
  Description of Combined DNA/RNA Molecule: Synthetic oligonucleotide
aagaaguguccccguaauutt

SEQ ID NO: 1662 - DNA, 21 bp, Artificial Sequence
  Description of Artificial Sequence: Synthetic oligonucleotide
  Description of Combined DNA/RNA Molecule: Synthetic oligonucleotide
aauuacggggacacuucuutt

SEQ ID NO: 1663 - DNA, 21 bp, Artificial Sequence
  Description of Artificial Sequence: Synthetic oligonucleotide
  Description of Combined DNA/RNA Molecule: Synthetic oligonucleotide
agaaguguccccguaauuatt

SEQ ID NO: 1664 - DNA, 21 bp, Artificial Sequence
  Description of Artificial Sequence: Synthetic oligonucleotide
  Description of Combined DNA/RNA Molecule: Synthetic oligonucleotide
uaauuacggggacacuucutt

SEQ ID NO: 1665 - DNA, 21 bp, Artificial Sequence
  Description of Artificial Sequence: Synthetic oligonucleotide
  Description of Combined DNA/RNA Molecule: Synthetic oligonucleotide
gaaguguccccguaauuautt

SEQ ID NO: 1666 - DNA, 21 bp, Artificial Sequence
  Description of Artificial Sequence: Synthetic oligonucleotide
  Description of Combined DNA/RNA Molecule: Synthetic oligonucleotide
auaauuacggggacacuuctt

SEQ ID NO: 1667 - DNA, 21 bp, Artificial Sequence
  Description of Artificial Sequence: Synthetic oligonucleotide
  Description of Combined DNA/RNA Molecule: Synthetic oligonucleotide
aaguguccccguaauuaugtt

SEQ ID NO: 1668 - DNA, 21 bp, Artificial Sequence
  Description of Artificial Sequence: Synthetic oligonucleotide
  Description of Combined DNA/RNA Molecule: Synthetic oligonucleotide
cauaauuacggggacacuutt

SEQ ID NO: 1669 - DNA, 21 bp, Artificial Sequence
  Description of Artificial Sequence: Synthetic oligonucleotide
  Description of Combined DNA/RNA Molecule: Synthetic oligonucleotide
aguguccccguaauuaugutt

SEQ ID NO: 1670 - DNA, 21 bp, Artificial Sequence
  Description of Artificial Sequence: Synthetic oligonucleotide
  Description of Combined DNA/RNA Molecule: Synthetic oligonucleotide
acauaauuacggggacacutt

SEQ ID NO: 1671 - DNA, 21 bp, Artificial Sequence
  Description of Artificial Sequence: Synthetic oligonucleotide
  Description of Combined DNA/RNA Molecule: Synthetic oligonucleotide
guguccccguaauuaugugtt

SEQ ID NO: 1672 - DNA, 21 bp, Artificial Sequence
  Description of Artificial Sequence: Synthetic oligonucleotide
  Description of Combined DNA/RNA Molecule: Synthetic oligonucleotide
cacauaauuacggggacactt

SEQ ID NO: 1673 - DNA, 21 bp, Artificial Sequence
  Description of Artificial Sequence: Synthetic oligonucleotide
  Description of Combined DNA/RNA Molecule: Synthetic oligonucleotide
uguccccguaauuauguggtt

SEQ ID NO: 1674 - DNA, 21 bp, Artificial Sequence
  Description of Artificial Sequence: Synthetic oligonucleotide
  Description of Combined DNA/RNA Molecule: Synthetic oligonucleotide
ccacauaauuacggggacatt

SEQ ID NO: 1675 - DNA, 21 bp, Artificial Sequence
  Description of Artificial Sequence: Synthetic oligonucleotide
  Description of Combined DNA/RNA Molecule: Synthetic oligonucleotide
guccccguaauuauguggutt

SEQ ID NO: 1676 - DNA, 21 bp, Artificial Sequence
  Description of Artificial Sequence: Synthetic oligonucleotide
  Description of Combined DNA/RNA Molecule: Synthetic oligonucleotide
accacauaauuacggggactt

SEQ ID NO: 1677 - DNA, 21 bp, Artificial Sequence
  Description of Artificial Sequence: Synthetic oligonucleotide
  Description of Combined DNA/RNA Molecule: Synthetic oligonucleotide
ccccguaauuauguggugatt

SEQ ID NO: 1678 - DNA, 21 bp, Artificial Sequence
  Description of Artificial Sequence: Synthetic oligonucleotide
  Description of Combined DNA/RNA Molecule: Synthetic oligonucleotide
ucaccacauaauuacggggtt

SEQ ID NO: 1679 - DNA, 21 bp, Artificial Sequence
  Description of Artificial Sequence: Synthetic oligonucleotide
  Description of Combined DNA/RNA Molecule: Synthetic oligonucleotide
ccguaauuauguggugacatt

SEQ ID NO: 1680 - DNA, 21 bp, Artificial Sequence
  Description of Artificial Sequence: Synthetic oligonucleotide
  Description of Combined DNA/RNA Molecule: Synthetic oligonucleotide
ugucaccacauaauuacggtt

SEQ ID NO: 1681 - DNA, 21 bp, Artificial Sequence
  Description of Artificial Sequence: Synthetic oligonucleotide
  Description of Combined DNA/RNA Molecule: Synthetic oligonucleotide
guaauuauguggugacagatt

SEQ ID NO: 1682 - DNA, 21 bp, Artificial Sequence
  Description of Artificial Sequence: Synthetic oligonucleotide
  Description of Combined DNA/RNA Molecule: Synthetic oligonucleotide
ucugucaccacauaauuactt

SEQ ID NO: 1683 - DNA, 21 bp, Artificial Sequence
  Description of Artificial Sequence: Synthetic oligonucleotide
  Description of Combined DNA/RNA Molecule: Synthetic oligonucleotide
uaauuauguggugacagautt

SEQ ID NO: 1684 - DNA, 21 bp, Artificial Sequence
  Description of Artificial Sequence: Synthetic oligonucleotide
  Description of Combined DNA/RNA Molecule: Synthetic oligonucleotide
aucugucaccacauaauuatt

SEQ ID NO: 1685 - DNA, 21 bp, Artificial Sequence
  Description of Artificial Sequence: Synthetic oligonucleotide
  Description of Combined DNA/RNA Molecule: Synthetic oligonucleotide
aauuauguggugacagauctt

SEQ ID NO: 1686 - DNA, 21 bp, Artificial Sequence
  Description of Artificial Sequence: Synthetic oligonucleotide
  Description of Combined DNA/RNA Molecule: Synthetic oligonucleotide
gaucugucaccacauaauutt

SEQ ID NO: 1687 - DNA, 21 bp, Artificial Sequence
  Description of Artificial Sequence: Synthetic oligonucleotide
  Description of Combined DNA/RNA Molecule: Synthetic oligonucleotide
auuauguggugacagaucatt

SEQ ID NO: 1688 - DNA, 21 bp, Artificial Sequence
  Description of Artificial Sequence: Synthetic oligonucleotide
  Description of Combined DNA/RNA Molecule: Synthetic oligonucleotide
ugaucugucaccacauaautt

SEQ ID NO: 1689 - DNA, 21 bp, Artificial Sequence
  Description of Artificial Sequence: Synthetic oligonucleotide
  Description of Combined DNA/RNA Molecule: Synthetic oligonucleotide
uuauguggugacagaucactt

SEQ ID NO: 1690 - DNA, 21 bp, Artificial Sequence
  Description of Artificial Sequence: Synthetic oligonucleotide
  Description of Combined DNA/RNA Molecule: Synthetic oligonucleotide
gugaucugucaccacauaatt

SEQ ID NO: 1691 - DNA, 21 bp, Artificial Sequence
  Description of Artificial Sequence: Synthetic oligonucleotide
  Description of Combined DNA/RNA Molecule: Synthetic oligonucleotide
auguggugacagaucacggtt

SEQ ID NO: 1692 - DNA, 21 bp, Artificial Sequence
  Description of Artificial Sequence: Synthetic oligonucleotide
  Description of Combined DNA/RNA Molecule: Synthetic oligonucleotide
ccgugaucugucaccacautt

SEQ ID NO: 1693 - DNA, 21 bp, Artificial Sequence
  Description of Artificial Sequence: Synthetic oligonucleotide
  Description of Combined DNA/RNA Molecule: Synthetic oligonucleotide
uggugacagaucacggcuctt

SEQ ID NO: 1694 - DNA, 21 bp, Artificial Sequence
  Description of Artificial Sequence: Synthetic oligonucleotide
  Description of Combined DNA/RNA Molecule: Synthetic oligonucleotide
gagccgugaucugucaccatt

SEQ ID NO: 1695 - DNA, 21 bp, Artificial Sequence
  Description of Artificial Sequence: Synthetic oligonucleotide
  Description of Combined DNA/RNA Molecule: Synthetic oligonucleotide
gugacagaucacggcucgutt

SEQ ID NO: 1696 - DNA, 21 bp, Artificial Sequence
  Description of Artificial Sequence: Synthetic oligonucleotide
  Description of Combined DNA/RNA Molecule: Synthetic oligonucleotide
acgagccgugaucugucactt

SEQ ID NO: 1697 - DNA, 21 bp, Artificial Sequence
  Description of Artificial Sequence: Synthetic oligonucleotide
  Description of Combined DNA/RNA Molecule: Synthetic oligonucleotide
ugacagaucacggcucgugtt

SEQ ID NO: 1698 - DNA, 21 bp, Artificial Sequence
  Description of Artificial Sequence: Synthetic oligonucleotide
  Description of Combined DNA/RNA Molecule: Synthetic oligonucleotide
cacgagccgugaucugucatt

SEQ ID NO: 1699 - DNA, 21 bp, Artificial Sequence
  Description of Artificial Sequence: Synthetic oligonucleotide
  Description of Combined DNA/RNA Molecule: Synthetic oligonucleotide
gacagaucacggcucgugctt

SEQ ID NO: 1700 - DNA, 21 bp, Artificial Sequence
  Description of Artificial Sequence: Synthetic oligonucleotide
  Description of Combined DNA/RNA Molecule: Synthetic oligonucleotide
gcacgagccgugaucuguctt

SEQ ID NO: 1701 - DNA, 21 bp, Artificial Sequence
  Description of Artificial Sequence: Synthetic oligonucleotide
  Description of Combined DNA/RNA Molecule: Synthetic oligonucleotide
acagaucacggcucgugcgtt

SEQ ID NO: 1702 - DNA, 21 bp, Artificial Sequence
  Description of Artificial Sequence: Synthetic oligonucleotide
  Description of Combined DNA/RNA Molecule: Synthetic oligonucleotide
cgcacgagccgugaucugutt

SEQ ID NO: 1703 - DNA, 21 bp, Artificial Sequence
  Description of Artificial Sequence: Synthetic oligonucleotide
  Description of Combined DNA/RNA Molecule: Synthetic oligonucleotide
cagaucacggcucgugcgutt

SEQ ID NO: 1704 - DNA, 21 bp, Artificial Sequence
  Description of Artificial Sequence: Synthetic oligonucleotide
  Description of Combined DNA/RNA Molecule: Synthetic oligonucleotide
acgcacgagccgugaucugtt

SEQ ID NO: 1705 - DNA, 21 bp, Artificial Sequence
  Description of Artificial Sequence: Synthetic oligonucleotide
  Description of Combined DNA/RNA Molecule: Synthetic oligonucleotide
agaucacggcucgugcguctt

SEQ ID NO: 1706 - DNA, 21 bp, Artificial Sequence
  Description of Artificial Sequence: Synthetic oligonucleotide
  Description of Combined DNA/RNA Molecule: Synthetic oligonucleotide
gacgcacgagccgugaucutt

SEQ ID NO: 1707 - DNA, 21 bp, Artificial Sequence
  Description of Artificial Sequence: Synthetic oligonucleotide
  Description of Combined DNA/RNA Molecule: Synthetic oligonucleotide
gaucacggcucgugcgucctt

SEQ ID NO: 1708 - DNA, 21 bp, Artificial Sequence
  Description of Artificial Sequence: Synthetic oligonucleotide
  Description of Combined DNA/RNA Molecule: Synthetic oligonucleotide
ggacgcacgagccgugauctt

SEQ ID NO: 1709 - DNA, 21 bp, Artificial Sequence
  Description of Artificial Sequence: Synthetic oligonucleotide
  Description of Combined DNA/RNA Molecule: Synthetic oligonucleotide
aucacggcucgugcguccgtt

SEQ ID NO: 1710 - DNA, 21 bp, Artificial Sequence
  Description of Artificial Sequence: Synthetic oligonucleotide
  Description of Combined DNA/RNA Molecule: Synthetic oligonucleotide
cggacgcacgagccgugautt

SEQ ID NO: 1711 - DNA, 21 bp, Artificial Sequence
  Description of Artificial Sequence: Synthetic oligonucleotide
  Description of Combined DNA/RNA Molecule: Synthetic oligonucleotide
ucacggcucgugcguccgatt

SEQ ID NO: 1712 - DNA, 21 bp, Artificial Sequence
  Description of Artificial Sequence: Synthetic oligonucleotide
  Description of Combined DNA/RNA Molecule: Synthetic oligonucleotide
ucggacgcacgagccgugatt

SEQ ID NO: 1713 - DNA, 21 bp, Artificial Sequence
  Description of Artificial Sequence: Synthetic oligonucleotide
  Description of Combined DNA/RNA Molecule: Synthetic oligonucleotide
cacggcucgugcguccgagtt

SEQ ID NO: 1714 - DNA, 21 bp, Artificial Sequence
  Description of Artificial Sequence: Synthetic oligonucleotide
  Description of Combined DNA/RNA Molecule: Synthetic oligonucleotide
cucggacgcacgagccgugtt

SEQ ID NO: 1715 - DNA, 21 bp, Artificial Sequence
  Description of Artificial Sequence: Synthetic oligonucleotide
  Description of Combined DNA/RNA Molecule: Synthetic oligonucleotide
acggcucgugcguccgagctt

SEQ ID NO: 1716 - DNA, 21 bp, Artificial Sequence
  Description of Artificial Sequence: Synthetic oligonucleotide
  Description of Combined DNA/RNA Molecule: Synthetic oligonucleotide
gcucggacgcacgagccgutt

SEQ ID NO: 1717 - DNA, 21 bp, Artificial Sequence
  Description of Artificial Sequence: Synthetic oligonucleotide
  Description of Combined DNA/RNA Molecule: Synthetic oligonucleotide
gcucgugcguccgagccugtt

SEQ ID NO: 1718 - DNA, 21 bp, Artificial Sequence
  Description of Artificial Sequence: Synthetic oligonucleotide
  Description of Combined DNA/RNA Molecule: Synthetic oligonucleotide
caggcucggacgcacgagctt

SEQ ID NO: 1719 - DNA, 21 bp, Artificial Sequence
  Description of Artificial Sequence: Synthetic oligonucleotide
  Description of Combined DNA/RNA Molecule: Synthetic oligonucleotide
ggaggaagacggcguccgctt

SEQ ID NO: 1720 - DNA, 21 bp, Artificial Sequence
  Description of Artificial Sequence: Synthetic oligonucleotide
  Description of Combined DNA/RNA Molecule: Synthetic oligonucleotide
gcggacgccgucuuccucctt

SEQ ID NO: 1721 - DNA, 21 bp, Artificial Sequence
  Description of Artificial Sequence: Synthetic oligonucleotide
  Description of Combined DNA/RNA Molecule: Synthetic oligonucleotide
gaggaagacggcguccgcatt

SEQ ID NO: 1722 - DNA, 21 bp, Artificial Sequence
  Description of Artificial Sequence: Synthetic oligonucleotide
  Description of Combined DNA/RNA Molecule: Synthetic oligonucleotide
ugcggacgccgucuuccuctt

SEQ ID NO: 1723 - DNA, 21 bp, Artificial Sequence
  Description of Artificial Sequence: Synthetic oligonucleotide
  Description of Combined DNA/RNA Molecule: Synthetic oligonucleotide
ggaagacggcguccgcaagtt

SEQ ID NO: 1724 - DNA, 21 bp, Artificial Sequence
  Description of Artificial Sequence: Synthetic oligonucleotide
  Description of Combined DNA/RNA Molecule: Synthetic oligonucleotide
cuugcggacgccgucuucctt

SEQ ID NO: 1725 - DNA, 21 bp, Artificial Sequence
  Description of Artificial Sequence: Synthetic oligonucleotide
  Description of Combined DNA/RNA Molecule: Synthetic oligonucleotide
gaagacggcguccgcaagutt

SEQ ID NO: 1726 - DNA, 21 bp, Artificial Sequence
  Description of Artificial Sequence: Synthetic oligonucleotide
  Description of Combined DNA/RNA Molecule: Synthetic oligonucleotide
acuugcggacgccgucuuctt

SEQ ID NO: 1727 - DNA, 21 bp, Artificial Sequence
  Description of Artificial Sequence: Synthetic oligonucleotide
  Description of Combined DNA/RNA Molecule: Synthetic oligonucleotide
aagacggcguccgcaagugtt

SEQ ID NO: 1728 - DNA, 21 bp, Artificial Sequence
  Description of Artificial Sequence: Synthetic oligonucleotide
  Description of Combined DNA/RNA Molecule: Synthetic oligonucleotide
cacuugcggacgccgucuutt

SEQ ID NO: 1729 - DNA, 21 bp, Artificial Sequence
  Description of Artificial Sequence: Synthetic oligonucleotide
  Description of Combined DNA/RNA Molecule: Synthetic oligonucleotide
gacggcguccgcaaguguatt

SEQ ID NO: 1730 - DNA, 21 bp, Artificial Sequence
  Description of Artificial Sequence: Synthetic oligonucleotide
  Description of Combined DNA/RNA Molecule: Synthetic oligonucleotide
uacacuugcggacgccguctt

SEQ ID NO: 1731 - DNA, 21 bp, Artificial Sequence
  Description of Artificial Sequence: Synthetic oligonucleotide
  Description of Combined DNA/RNA Molecule: Synthetic oligonucleotide
acggcguccgcaaguguaatt

SEQ ID NO: 1732 - DNA, 21 bp, Artificial Sequence
  Description of Artificial Sequence: Synthetic oligonucleotide
  Description of Combined DNA/RNA Molecule: Synthetic oligonucleotide
uuacacuugcggacgccgutt

SEQ ID NO: 1733 - DNA, 21 bp, Artificial Sequence
  Description of Artificial Sequence: Synthetic oligonucleotide
  Description of Combined DNA/RNA Molecule: Synthetic oligonucleotide
gcguccgcaaguguaagaatt

SEQ ID NO: 1734 - DNA, 21 bp, Artificial Sequence
  Description of Artificial Sequence: Synthetic oligonucleotide
  Description of Combined DNA/RNA Molecule: Synthetic oligonucleotide
uucuuacacuugcggacgctt

SEQ ID NO: 1735 - DNA, 21 bp, Artificial Sequence
  Description of Artificial Sequence: Synthetic oligonucleotide
  Description of Combined DNA/RNA Molecule: Synthetic oligonucleotide
cguccgcaaguguaagaagtt

SEQ ID NO: 1736 - DNA, 21 bp, Artificial Sequence
  Description of Artificial Sequence: Synthetic oligonucleotide
  Description of Combined DNA/RNA Molecule: Synthetic oligonucleotide
cuucuuacacuugcggacgtt

SEQ ID NO: 1737 - DNA, 21 bp, Artificial Sequence
  Description of Artificial Sequence: Synthetic oligonucleotide
  Description of Combined DNA/RNA Molecule: Synthetic oligonucleotide
guccgcaaguguaagaagutt

SEQ ID NO: 1738 - DNA, 21 bp, Artificial Sequence
  Description of Artificial Sequence: Synthetic oligonucleotide
  Description of Combined DNA/RNA Molecule: Synthetic oligonucleotide
acuucuuacacuugcggactt

SEQ ID NO: 1739 - DNA, 21 bp, Artificial Sequence
  Description of Artificial Sequence: Synthetic oligonucleotide
  Description of Combined DNA/RNA Molecule: Synthetic oligonucleotide
uccgcaaguguaagaagugtt

SEQ ID NO: 1740 - DNA, 21 bp, Artificial Sequence
  Description of Artificial Sequence: Synthetic oligonucleotide
  Description of Combined DNA/RNA Molecule: Synthetic oligonucleotide
cacuucuuacacuugcggatt

SEQ ID NO: 1741 - DNA, 21 bp, Artificial Sequence
  Description of Artificial Sequence: Synthetic oligonucleotide
  Description of Combined DNA/RNA Molecule: Synthetic oligonucleotide
ccgcaaguguaagaagugctt

SEQ ID NO: 1742 - DNA, 21 bp, Artificial Sequence
  Description of Artificial Sequence: Synthetic oligonucleotide
  Description of Combined DNA/RNA Molecule: Synthetic oligonucleotide
gcacuucuuacacuugcggtt

SEQ ID NO: 1743 - DNA, 21 bp, Artificial Sequence
  Description of Artificial Sequence: Synthetic oligonucleotide
  Description of Combined DNA/RNA Molecule: Synthetic oligonucleotide
cgcaaguguaagaagugcgtt

SEQ ID NO: 1744 - DNA, 21 bp, Artificial Sequence
  Description of Artificial Sequence: Synthetic oligonucleotide
  Description of Combined DNA/RNA Molecule: Synthetic oligonucleotide
cgcacuucuuacacuugcgtt

SEQ ID NO: 1745 - DNA, 21 bp, Artificial Sequence
  Description of Artificial Sequence: Synthetic oligonucleotide
  Description of Combined DNA/RNA Molecule: Synthetic oligonucleotide
gcaaguguaagaagugcgatt

SEQ ID NO: 1746 - DNA, 21 bp, Artificial Sequence
  Description of Artificial Sequence: Synthetic oligonucleotide
  Description of Combined DNA/RNA Molecule: Synthetic oligonucleotide
ucgcacuucuuacacuugctt

SEQ ID NO: 1747 - DNA, 21 bp, Artificial Sequence
  Description of Artificial Sequence: Synthetic oligonucleotide
  Description of Combined DNA/RNA Molecule: Synthetic oligonucleotide
aaguguaagaagugcgaagtt

SEQ ID NO: 1748 - DNA, 21 bp, Artificial Sequence
  Description of Artificial Sequence: Synthetic oligonucleotide
  Description of Combined DNA/RNA Molecule: Synthetic oligonucleotide
cuucgcacuucuuacacuutt

SEQ ID NO: 1749 - DNA, 21 bp, Artificial Sequence
  Description of Artificial Sequence: Synthetic oligonucleotide
  Description of Combined DNA/RNA Molecule: Synthetic oligonucleotide
aguguaagaagugcgaaggtt

SEQ ID NO: 1750 - DNA, 21 bp, Artificial Sequence
  Description of Artificial Sequence: Synthetic oligonucleotide
  Description of Combined DNA/RNA Molecule: Synthetic oligonucleotide
ccuucgcacuucuuacacutt

SEQ ID NO: 1751 - DNA, 21 bp, Artificial Sequence
  Description of Artificial Sequence: Synthetic oligonucleotide
  Description of Combined DNA/RNA Molecule: Synthetic oligonucleotide
guguaagaagugcgaagggtt

SEQ ID NO: 1752 - DNA, 21 bp, Artificial Sequence
  Description of Artificial Sequence: Synthetic oligonucleotide
  Description of Combined DNA/RNA Molecule: Synthetic oligonucleotide
cccuucgcacuucuuacactt

SEQ ID NO: 1753 - DNA, 21 bp, Artificial Sequence
  Description of Artificial Sequence: Synthetic oligonucleotide
  Description of Combined DNA/RNA Molecule: Synthetic oligonucleotide
uguaagaagugcgaagggctt

SEQ ID NO: 1754 - DNA, 21 bp, Artificial Sequence
  Description of Artificial Sequence: Synthetic oligonucleotide
  Description of Combined DNA/RNA Molecule: Synthetic oligonucleotide
gcccuucgcacuucuuacatt

SEQ ID NO: 1755 - DNA, 21 bp, Artificial Sequence
  Description of Artificial Sequence: Synthetic oligonucleotide
  Description of Combined DNA/RNA Molecule: Synthetic oligonucleotide
guaagaagugcgaagggcctt

SEQ ID NO: 1756 - DNA, 21 bp, Artificial Sequence
  Description of Artificial Sequence: Synthetic oligonucleotide
  Description of Combined DNA/RNA Molecule: Synthetic oligonucleotide
ggcccuucgcacuucuuactt

SEQ ID NO: 1757 - DNA, 21 bp, Artificial Sequence
  Description of Artificial Sequence: Synthetic oligonucleotide
  Description of Combined DNA/RNA Molecule: Synthetic oligonucleotide
uaagaagugcgaagggccutt

SEQ ID NO: 1758 - DNA, 21 bp, Artificial Sequence
  Description of Artificial Sequence: Synthetic oligonucleotide
  Description of Combined DNA/RNA Molecule: Synthetic oligonucleotide
aggcccuucgcacuucuuatt

SEQ ID NO: 1759 - DNA, 21 bp, Artificial Sequence
  Description of Artificial Sequence: Synthetic oligonucleotide
  Description of Combined DNA/RNA Molecule: Synthetic oligonucleotide
aagaagugcgaagggccuutt

SEQ ID NO: 1760 - DNA, 21 bp, Artificial Sequence
  Description of Artificial Sequence: Synthetic oligonucleotide
  Description of Combined DNA/RNA Molecule: Synthetic oligonucleotide
aaggcccuucgcacuucuutt

SEQ ID NO: 1761 - DNA, 21 bp, Artificial Sequence
  Description of Artificial Sequence: Synthetic oligonucleotide
  Description of Combined DNA/RNA Molecule: Synthetic oligonucleotide
agaagugcgaagggccuugtt

SEQ ID NO: 1762 - DNA, 21 bp, Artificial Sequence
  Description of Artificial Sequence: Synthetic oligonucleotide
  Description of Combined DNA/RNA Molecule: Synthetic oligonucleotide
caaggcccuucgcacuucutt

SEQ ID NO: 1763 - DNA, 21 bp, Artificial Sequence
  Description of Artificial Sequence: Synthetic oligonucleotide
  Description of Combined DNA/RNA Molecule: Synthetic oligonucleotide
agugcgaagggccuugccgtt

SEQ ID NO: 1764 - DNA, 21 bp, Artificial Sequence
  Description of Artificial Sequence: Synthetic oligonucleotide
  Description of Combined DNA/RNA Molecule: Synthetic oligonucleotide
cggcaaggcccuucgcacutt

SEQ ID NO: 1765 - DNA, 21 bp, Artificial Sequence
  Description of Artificial Sequence: Synthetic oligonucleotide
  Description of Combined DNA/RNA Molecule: Synthetic oligonucleotide
gugcgaagggccuugccgctt

SEQ ID NO: 1766 - DNA, 21 bp, Artificial Sequence
  Description of Artificial Sequence: Synthetic oligonucleotide
  Description of Combined DNA/RNA Molecule: Synthetic oligonucleotide
gcggcaaggcccuucgcactt

SEQ ID NO: 1767 - DNA, 21 bp, Artificial Sequence
  Description of Artificial Sequence: Synthetic oligonucleotide
  Description of Combined DNA/RNA Molecule: Synthetic oligonucleotide
ugcgaagggccuugccgcatt

SEQ ID NO: 1768 - DNA, 21 bp, Artificial Sequence
  Description of Artificial Sequence: Synthetic oligonucleotide
  Description of Combined DNA/RNA Molecule: Synthetic oligonucleotide
ugcggcaaggcccuucgcatt

SEQ ID NO: 1769 - DNA, 21 bp, Artificial Sequence
  Description of Artificial Sequence: Synthetic oligonucleotide
  Description of Combined DNA/RNA Molecule: Synthetic oligonucleotide
gcgaagggccuugccgcaatt

SEQ ID NO: 1770 - DNA, 21 bp, Artificial Sequence
  Description of Artificial Sequence: Synthetic oligonucleotide
  Description of Combined DNA/RNA Molecule: Synthetic oligonucleotide
uugcggcaaggcccuucgctt

SEQ ID NO: 1771 - DNA, 21 bp, Artificial Sequence
  Description of Artificial Sequence: Synthetic oligonucleotide
  Description of Combined DNA/RNA Molecule: Synthetic oligonucleotide
cgaagggccuugccgcaaatt

SEQ ID NO: 1772 - DNA, 21 bp, Artificial Sequence
  Description of Artificial Sequence: Synthetic oligonucleotide
  Description of Combined DNA/RNA Molecule: Synthetic oligonucleotide
uuugcggcaaggcccuucgtt

SEQ ID NO: 1773 - DNA, 21 bp, Artificial Sequence
  Description of Artificial Sequence: Synthetic oligonucleotide
  Description of Combined DNA/RNA Molecule: Synthetic oligonucleotide
aagggccuugccgcaaagutt

SEQ ID NO: 1774 - DNA, 21 bp, Artificial Sequence
  Description of Artificial Sequence: Synthetic oligonucleotide
  Description of Combined DNA/RNA Molecule: Synthetic oligonucleotide
acuuugcggcaaggcccuutt

SEQ ID NO: 1775 - DNA, 21 bp, Artificial Sequence
  Description of Artificial Sequence: Synthetic oligonucleotide
  Description of Combined DNA/RNA Molecule: Synthetic oligonucleotide
agggccuugccgcaaagugtt

SEQ ID NO: 1776 - DNA, 21 bp, Artificial Sequence
  Description of Artificial Sequence: Synthetic oligonucleotide
  Description of Combined DNA/RNA Molecule: Synthetic oligonucleotide
cacuuugcggcaaggcccutt

SEQ ID NO: 1777 - DNA, 21 bp, Artificial Sequence
  Description of Artificial Sequence: Synthetic oligonucleotide
  Description of Combined DNA/RNA Molecule: Synthetic oligonucleotide
gggccuugccgcaaagugutt

SEQ ID NO: 1778 - DNA, 21 bp, Artificial Sequence
  Description of Artificial Sequence: Synthetic oligonucleotide
  Description of Combined DNA/RNA Molecule: Synthetic oligonucleotide
acacuuugcggcaaggccctt

SEQ ID NO: 1779 - DNA, 21 bp, Artificial Sequence
  Description of Artificial Sequence: Synthetic oligonucleotide
  Description of Combined DNA/RNA Molecule: Synthetic oligonucleotide
ggccuugccgcaaagugugtt

SEQ ID NO: 1780 - DNA, 21 bp, Artificial Sequence
  Description of Artificial Sequence: Synthetic oligonucleotide
  Description of Combined DNA/RNA Molecule: Synthetic oligonucleotide
cacacuuugcggcaaggcctt

SEQ ID NO: 1781 - DNA, 21 bp, Artificial Sequence
  Description of Artificial Sequence: Synthetic oligonucleotide
  Description of Combined DNA/RNA Molecule: Synthetic oligonucleotide
gccuugccgcaaagugugutt

SEQ ID NO: 1782 - DNA, 21 bp, Artificial Sequence
  Description of Artificial Sequence: Synthetic oligonucleotide
  Description of Combined DNA/RNA Molecule: Synthetic oligonucleotide
acacacuuugcggcaaggctt

SEQ ID NO: 1783 - DNA, 21 bp, Artificial Sequence
  Description of Artificial Sequence: Synthetic oligonucleotide
  Description of Combined DNA/RNA Molecule: Synthetic oligonucleotide
cuugccgcaaaguguguaatt

SEQ ID NO: 1784 - DNA, 21 bp, Artificial Sequence
  Description of Artificial Sequence: Synthetic oligonucleotide
  Description of Combined DNA/RNA Molecule: Synthetic oligonucleotide
uuacacacuuugcggcaagtt

SEQ ID NO: 1785 - DNA, 21 bp, Artificial Sequence
  Description of Artificial Sequence: Synthetic oligonucleotide
  Description of Combined DNA/RNA Molecule: Synthetic oligonucleotide
ggaauagguauuggugaautt

SEQ ID NO: 1786 - DNA, 21 bp, Artificial Sequence
  Description of Artificial Sequence: Synthetic oligonucleotide
  Description of Combined DNA/RNA Molecule: Synthetic oligonucleotide
auucaccaauaccuauucctt

SEQ ID NO: 1787 - DNA, 21 bp, Artificial Sequence
  Description of Artificial Sequence: Synthetic oligonucleotide
  Description of Combined DNA/RNA Molecule: Synthetic oligonucleotide
gaauagguauuggugaauutt

SEQ ID NO: 1788 - DNA, 21 bp, Artificial Sequence
  Description of Artificial Sequence: Synthetic oligonucleotide
  Description of Combined DNA/RNA Molecule: Synthetic oligonucleotide
aauucaccaauaccuauuctt

SEQ ID NO: 1789 - DNA, 21 bp, Artificial Sequence
  Description of Artificial Sequence: Synthetic oligonucleotide
  Description of Combined DNA/RNA Molecule: Synthetic oligonucleotide
aauagguauuggugaauuutt

SEQ ID NO: 1790 - DNA, 21 bp, Artificial Sequence
  Description of Artificial Sequence: Synthetic oligonucleotide
  Description of Combined DNA/RNA Molecule: Synthetic oligonucleotide
aaauucaccaauaccuauutt

SEQ ID NO: 1791 - DNA, 21 bp, Artificial Sequence
  Description of Artificial Sequence: Synthetic oligonucleotide
  Description of Combined DNA/RNA Molecule: Synthetic oligonucleotide
auagguauuggugaauuuatt

SEQ ID NO: 1792 - DNA, 21 bp, Artificial Sequence
  Description of Artificial Sequence: Synthetic oligonucleotide
  Description of Combined DNA/RNA Molecule: Synthetic oligonucleotide
uaaauucaccaauaccuautt

SEQ ID NO: 1793 - DNA, 21 bp, Artificial Sequence
  Description of Artificial Sequence: Synthetic oligonucleotide
  Description of Combined DNA/RNA Molecule: Synthetic oligonucleotide
agguauuggugaauuuaaatt

SEQ ID NO: 1794 - DNA, 21 bp, Artificial Sequence
  Description of Artificial Sequence: Synthetic oligonucleotide
  Description of Combined DNA/RNA Molecule: Synthetic oligonucleotide
uuuaaauucaccaauaccutt

SEQ ID NO: 1795 - DNA, 21 bp, Artificial Sequence
  Description of Artificial Sequence: Synthetic oligonucleotide
  Description of Combined DNA/RNA Molecule: Synthetic oligonucleotide
gguauuggugaauuuaaagtt

SEQ ID NO: 1796 - DNA, 21 bp, Artificial Sequence
  Description of Artificial Sequence: Synthetic oligonucleotide
  Description of Combined DNA/RNA Molecule: Synthetic oligonucleotide
cuuuaaauucaccaauacctt

SEQ ID NO: 1797 - DNA, 21 bp, Artificial Sequence
  Description of Artificial Sequence: Synthetic oligonucleotide
  Description of Combined DNA/RNA Molecule: Synthetic oligonucleotide
cacucuccauaaaugcuactt

SEQ ID NO: 1798 - DNA, 21 bp, Artificial Sequence
  Description of Artificial Sequence: Synthetic oligonucleotide
  Description of Combined DNA/RNA Molecule: Synthetic oligonucleotide
guagcauuuauggagagugtt

SEQ ID NO: 1799 - DNA, 21 bp, Artificial Sequence
  Description of Artificial Sequence: Synthetic oligonucleotide
  Description of Combined DNA/RNA Molecule: Synthetic oligonucleotide
uuaaacacuucaaaaacugtt

SEQ ID NO: 1800 - DNA, 21 bp, Artificial Sequence
  Description of Artificial Sequence: Synthetic oligonucleotide
  Description of Combined DNA/RNA Molecule: Synthetic oligonucleotide
caguuuuugaaguguuuaatt

SEQ ID NO: 1801 - DNA, 21 bp, Artificial Sequence
  Description of Artificial Sequence: Synthetic oligonucleotide
  Description of Combined DNA/RNA Molecule: Synthetic oligonucleotide
cuucaaaaacugcaccucctt

SEQ ID NO: 1802 - DNA, 21 bp, Artificial Sequence
  Description of Artificial Sequence: Synthetic oligonucleotide
  Description of Combined DNA/RNA Molecule: Synthetic oligonucleotide
ggaggugcaguuuuugaagtt

SEQ ID NO: 1803 - DNA, 21 bp, Artificial Sequence
  Description of Artificial Sequence: Synthetic oligonucleotide
  Description of Combined DNA/RNA Molecule: Synthetic oligonucleotide
uucaaaaacugcaccuccatt

SEQ ID NO: 1804 - DNA, 21 bp, Artificial Sequence
  Description of Artificial Sequence: Synthetic oligonucleotide
  Description of Combined DNA/RNA Molecule: Synthetic oligonucleotide
uggaggugcaguuuuugaatt

SEQ ID NO: 1805 - DNA, 21 bp, Artificial Sequence
  Description of Artificial Sequence: Synthetic oligonucleotide
  Description of Combined DNA/RNA Molecule: Synthetic oligonucleotide
ucaaaaacugcaccuccautt

SEQ ID NO: 1806 - DNA, 21 bp, Artificial Sequence
  Description of Artificial Sequence: Synthetic oligonucleotide
  Description of Combined DNA/RNA Molecule: Synthetic oligonucleotide
auggaggugcaguuuuugatt

SEQ ID NO: 1807 - DNA, 21 bp, Artificial Sequence
  Description of Artificial Sequence: Synthetic oligonucleotide
  Description of Combined DNA/RNA Molecule: Synthetic oligonucleotide
caaaaacugcaccuccauctt

SEQ ID NO: 1808 - DNA, 21 bp, Artificial Sequence
  Description of Artificial Sequence: Synthetic oligonucleotide
  Description of Combined DNA/RNA Molecule: Synthetic oligonucleotide
gauggaggugcaguuuuugtt

SEQ ID NO: 1809 - DNA, 21 bp, Artificial Sequence
  Description of Artificial Sequence: Synthetic oligonucleotide
  Description of Combined DNA/RNA Molecule: Synthetic oligonucleotide
aaaaacugcaccuccaucatt

SEQ ID NO: 1810 - DNA, 21 bp, Artificial Sequence
  Description of Artificial Sequence: Synthetic oligonucleotide
  Description of Combined DNA/RNA Molecule: Synthetic oligonucleotide
ugauggaggugcaguuuuutt

SEQ ID NO: 1811 - DNA, 21 bp, Artificial Sequence
  Description of Artificial Sequence: Synthetic oligonucleotide
  Description of Combined DNA/RNA Molecule: Synthetic oligonucleotide
acugcaccuccaucaguggtt

SEQ ID NO: 1812 - DNA, 21 bp, Artificial Sequence
  Description of Artificial Sequence: Synthetic oligonucleotide
  Description of Combined DNA/RNA Molecule: Synthetic oligonucleotide
ccacugauggaggugcagutt

SEQ ID NO: 1813 - DNA, 21 bp, Artificial Sequence
  Description of Artificial Sequence: Synthetic oligonucleotide
  Description of Combined DNA/RNA Molecule: Synthetic oligonucleotide
caccuccaucaguggcgautt

SEQ ID NO: 1814 - DNA, 21 bp, Artificial Sequence
  Description of Artificial Sequence: Synthetic oligonucleotide
  Description of Combined DNA/RNA Molecule: Synthetic oligonucleotide
aucgccacugauggaggugtt

SEQ ID NO: 1815 - DNA, 21 bp, Artificial Sequence
  Description of Artificial Sequence: Synthetic oligonucleotide
  Description of Combined DNA/RNA Molecule: Synthetic oligonucleotide
accuccaucaguggcgauctt

SEQ ID NO: 1816 - DNA, 21 bp, Artificial Sequence
  Description of Artificial Sequence: Synthetic oligonucleotide
  Description of Combined DNA/RNA Molecule: Synthetic oligonucleotide
gaucgccacugauggaggutt

SEQ ID NO: 1817 - DNA, 21 bp, Artificial Sequence
  Description of Artificial Sequence: Synthetic oligonucleotide
  Description of Combined DNA/RNA Molecule: Synthetic oligonucleotide
cuccaucaguggcgaucuctt

SEQ ID NO: 1818 - DNA, 21 bp, Artificial Sequence
  Description of Artificial Sequence: Synthetic oligonucleotide
  Description of Combined DNA/RNA Molecule: Synthetic oligonucleotide
gagaucgccacugauggagtt

SEQ ID NO: 1819 - DNA, 21 bp, Artificial Sequence
  Description of Artificial Sequence: Synthetic oligonucleotide
  Description of Combined DNA/RNA Molecule: Synthetic oligonucleotide
caucaguggcgaucuccactt

SEQ ID NO: 1820 - DNA, 21 bp, Artificial Sequence
  Description of Artificial Sequence: Synthetic oligonucleotide
  Description of Combined DNA/RNA Molecule: Synthetic oligonucleotide
guggagaucgccacugaugtt

SEQ ID NO: 1821 - DNA, 21 bp, Artificial Sequence
  Description of Artificial Sequence: Synthetic oligonucleotide
  Description of Combined DNA/RNA Molecule: Synthetic oligonucleotide
uggcgaucuccacauccugtt

SEQ ID NO: 1822 - DNA, 21 bp, Artificial Sequence
  Description of Artificial Sequence: Synthetic oligonucleotide
  Description of Combined DNA/RNA Molecule: Synthetic oligonucleotide
caggauguggagaucgccatt

SEQ ID NO: 1823 - DNA, 21 bp, Artificial Sequence
  Description of Artificial Sequence: Synthetic oligonucleotide
  Description of Combined DNA/RNA Molecule: Synthetic oligonucleotide
ggcgaucuccacauccugctt

SEQ ID NO: 1824 - DNA, 21 bp, Artificial Sequence
  Description of Artificial Sequence: Synthetic oligonucleotide
  Description of Combined DNA/RNA Molecule: Synthetic oligonucleotide
gcaggauguggagaucgcctt

SEQ ID NO: 1825 - DNA, 21 bp, Artificial Sequence
  Description of Artificial Sequence: Synthetic oligonucleotide
  Description of Combined DNA/RNA Molecule: Synthetic oligonucleotide
gcgaucuccacauccugcctt

SEQ ID NO: 1826 - DNA, 21 bp, Artificial Sequence
  Description of Artificial Sequence: Synthetic oligonucleotide
  Description of Combined DNA/RNA Molecule: Synthetic oligonucleotide
ggcaggauguggagaucgctt

SEQ ID NO: 1827 - DNA, 21 bp, Artificial Sequence
  Description of Artificial Sequence: Synthetic oligonucleotide
  Description of Combined DNA/RNA Molecule: Synthetic oligonucleotide
cgaucuccacauccugccgtt

SEQ ID NO: 1828 - DNA, 21 bp, Artificial Sequence
  Description of Artificial Sequence: Synthetic oligonucleotide
  Description of Combined DNA/RNA Molecule: Synthetic oligonucleotide
cggcaggauguggagaucgtt

SEQ ID NO: 1829 - DNA, 21 bp, Artificial Sequence
  Description of Artificial Sequence: Synthetic oligonucleotide
  Description of Combined DNA/RNA Molecule: Synthetic oligonucleotide
gaucuccacauccugccggtt

SEQ ID NO: 1830 - DNA, 21 bp, Artificial Sequence
  Description of Artificial Sequence: Synthetic oligonucleotide
  Description of Combined DNA/RNA Molecule: Synthetic oligonucleotide
ccggcaggauguggagauctt

SEQ ID NO: 1831 - DNA, 21 bp, Artificial Sequence
  Description of Artificial Sequence: Synthetic oligonucleotide
  Description of Combined DNA/RNA Molecule: Synthetic oligonucleotide
ccacauccugccgguggcatt

SEQ ID NO: 1832 - DNA, 21 bp, Artificial Sequence
  Description of Artificial Sequence: Synthetic oligonucleotide
  Description of Combined DNA/RNA Molecule: Synthetic oligonucleotide
ugccaccggcaggauguggtt

SEQ ID NO: 1833 - DNA, 21 bp, Artificial Sequence
  Description of Artificial Sequence: Synthetic oligonucleotide
  Description of Combined DNA/RNA Molecule: Synthetic oligonucleotide
cacauccugccgguggcautt

SEQ ID NO: 1834 - DNA, 21 bp, Artificial Sequence
  Description of Artificial Sequence: Synthetic oligonucleotide
  Description of Combined DNA/RNA Molecule: Synthetic oligonucleotide
augccaccggcaggaugugtt

SEQ ID NO: 1835 - DNA, 21 bp, Artificial Sequence
  Description of Artificial Sequence: Synthetic oligonucleotide
  Description of Combined DNA/RNA Molecule: Synthetic oligonucleotide
acauccugccgguggcauutt

SEQ ID NO: 1836 - DNA, 21 bp, Artificial Sequence
  Description of Artificial Sequence: Synthetic oligonucleotide
  Description of Combined DNA/RNA Molecule: Synthetic oligonucleotide
aaugccaccggcaggaugutt

SEQ ID NO: 1837 - DNA, 21 bp, Artificial Sequence
  Description of Artificial Sequence: Synthetic oligonucleotide
  Description of Combined DNA/RNA Molecule: Synthetic oligonucleotide
auccugccgguggcauuuatt

SEQ ID NO: 1838 - DNA, 21 bp, Artificial Sequence
  Description of Artificial Sequence: Synthetic oligonucleotide
  Description of Combined DNA/RNA Molecule: Synthetic oligonucleotide
uaaaugccaccggcaggautt

SEQ ID NO: 1839 - DNA, 21 bp, Artificial Sequence
  Description of Artificial Sequence: Synthetic oligonucleotide
  Description of Combined DNA/RNA Molecule: Synthetic oligonucleotide
cugccgguggcauuuagggtt

SEQ ID NO: 1840 - DNA, 21 bp, Artificial Sequence
  Description of Artificial Sequence: Synthetic oligonucleotide
  Description of Combined DNA/RNA Molecule: Synthetic oligonucleotide
cccuaaaugccaccggcagtt

SEQ ID NO: 1841 - DNA, 21 bp, Artificial Sequence
  Description of Artificial Sequence: Synthetic oligonucleotide
  Description of Combined DNA/RNA Molecule: Synthetic oligonucleotide
ugccgguggcauuuaggggtt

SEQ ID NO: 1842 - DNA, 21 bp, Artificial Sequence
  Description of Artificial Sequence: Synthetic oligonucleotide
  Description of Combined DNA/RNA Molecule: Synthetic oligonucleotide
ccccuaaaugccaccggcatt

SEQ ID NO: 1843 - DNA, 21 bp, Artificial Sequence
  Description of Artificial Sequence: Synthetic oligonucleotide
  Description of Combined DNA/RNA Molecule: Synthetic oligonucleotide
gccgguggcauuuaggggutt

SEQ ID NO: 1844 - DNA, 21 bp, Artificial Sequence
  Description of Artificial Sequence: Synthetic oligonucleotide
  Description of Combined DNA/RNA Molecule: Synthetic oligonucleotide
accccuaaaugccaccggctt

SEQ ID NO: 1845 - DNA, 21 bp, Artificial Sequence
  Description of Artificial Sequence: Synthetic oligonucleotide
  Description of Combined DNA/RNA Molecule: Synthetic oligonucleotide
ccgguggcauuuaggggugtt

SEQ ID NO: 1846 - DNA, 21 bp, Artificial Sequence
  Description of Artificial Sequence: Synthetic oligonucleotide
  Description of Combined DNA/RNA Molecule: Synthetic oligonucleotide
caccccuaaaugccaccggtt

SEQ ID NO: 1847 - DNA, 21 bp, Artificial Sequence
  Description of Artificial Sequence: Synthetic oligonucleotide
  Description of Combined DNA/RNA Molecule: Synthetic oligonucleotide
guggcauuuaggggugacutt

SEQ ID NO: 1848 - DNA, 21 bp, Artificial Sequence
  Description of Artificial Sequence: Synthetic oligonucleotide
  Description of Combined DNA/RNA Molecule: Synthetic oligonucleotide
agucaccccuaaaugccactt

SEQ ID NO: 1849 - DNA, 21 bp, Artificial Sequence
  Description of Artificial Sequence: Synthetic oligonucleotide
  Description of Combined DNA/RNA Molecule: Synthetic oligonucleotide
gcauuuaggggugacuccutt

SEQ ID NO: 1850 - DNA, 21 bp, Artificial Sequence
  Description of Artificial Sequence: Synthetic oligonucleotide
  Description of Combined DNA/RNA Molecule: Synthetic oligonucleotide
aggagucaccccuaaaugctt

SEQ ID NO: 1851 - DNA, 21 bp, Artificial Sequence
  Description of Artificial Sequence: Synthetic oligonucleotide
  Description of Combined DNA/RNA Molecule: Synthetic oligonucleotide
cauuuaggggugacuccuutt

SEQ ID NO: 1852 - DNA, 21 bp, Artificial Sequence
  Description of Artificial Sequence: Synthetic oligonucleotide
  Description of Combined DNA/RNA Molecule: Synthetic oligonucleotide
aaggagucaccccuaaaugtt

SEQ ID NO: 1853 - DNA, 21 bp, Artificial Sequence
  Description of Artificial Sequence: Synthetic oligonucleotide
  Description of Combined DNA/RNA Molecule: Synthetic oligonucleotide
auuuaggggugacuccuuctt

SEQ ID NO: 1854 - DNA, 21 bp, Artificial Sequence
  Description of Artificial Sequence: Synthetic oligonucleotide
  Description of Combined DNA/RNA Molecule: Synthetic oligonucleotide
gaaggagucaccccuaaautt

SEQ ID NO: 1855 - DNA, 21 bp, Artificial Sequence
  Description of Artificial Sequence: Synthetic oligonucleotide
  Description of Combined DNA/RNA Molecule: Synthetic oligonucleotide
uuuaggggugacuccuucatt

SEQ ID NO: 1856 - DNA, 21 bp, Artificial Sequence
  Description of Artificial Sequence: Synthetic oligonucleotide
  Description of Combined DNA/RNA Molecule: Synthetic oligonucleotide
ugaaggagucaccccuaaatt

SEQ ID NO: 1857 - DNA, 21 bp, Artificial Sequence
  Description of Artificial Sequence: Synthetic oligonucleotide
  Description of Combined DNA/RNA Molecule: Synthetic oligonucleotide
uuaggggugacuccuucactt

SEQ ID NO: 1858 - DNA, 21 bp, Artificial Sequence
  Description of Artificial Sequence: Synthetic oligonucleotide
  Description of Combined DNA/RNA Molecule: Synthetic oligonucleotide
gugaaggagucaccccuaatt

SEQ ID NO: 1859 - DNA, 21 bp, Artificial Sequence
  Description of Artificial Sequence: Synthetic oligonucleotide
  Description of Combined DNA/RNA Molecule: Synthetic oligonucleotide
uaggggugacuccuucacatt

SEQ ID NO: 1860 - DNA, 21 bp, Artificial Sequence
  Description of Artificial Sequence: Synthetic oligonucleotide
  Description of Combined DNA/RNA Molecule: Synthetic oligonucleotide
ugugaaggagucaccccuatt

SEQ ID NO: 1861 - DNA, 21 bp, Artificial Sequence
  Description of Artificial Sequence: Synthetic oligonucleotide
  Description of Combined DNA/RNA Molecule: Synthetic oligonucleotide
ucuggauccacaggaacugtt

SEQ ID NO: 1862 - DNA, 21 bp, Artificial Sequence
  Description of Artificial Sequence: Synthetic oligonucleotide
  Description of Combined DNA/RNA Molecule: Synthetic oligonucleotide
caguuccuguggauccagatt

SEQ ID NO: 1863 - DNA, 21 bp, Artificial Sequence
  Description of Artificial Sequence: Synthetic oligonucleotide
  Description of Combined DNA/RNA Molecule: Synthetic oligonucleotide
gauccacaggaacuggauatt

SEQ ID NO: 1864 - DNA, 21 bp, Artificial Sequence
  Description of Artificial Sequence: Synthetic oligonucleotide
  Description of Combined DNA/RNA Molecule: Synthetic oligonucleotide
uauccaguuccuguggauctt

SEQ ID NO: 1865 - DNA, 21 bp, Artificial Sequence
  Description of Artificial Sequence: Synthetic oligonucleotide
  Description of Combined DNA/RNA Molecule: Synthetic oligonucleotide
auccacaggaacuggauautt

SEQ ID NO: 1866 - DNA, 21 bp, Artificial Sequence
  Description of Artificial Sequence: Synthetic oligonucleotide
  Description of Combined DNA/RNA Molecule: Synthetic oligonucleotide
auauccaguuccuguggautt

SEQ ID NO: 1867 - DNA, 21 bp, Artificial Sequence
  Description of Artificial Sequence: Synthetic oligonucleotide
  Description of Combined DNA/RNA Molecule: Synthetic oligonucleotide
ccacaggaacuggauauuctt

SEQ ID NO: 1868 - DNA, 21 bp, Artificial Sequence
  Description of Artificial Sequence: Synthetic oligonucleotide
  Description of Combined DNA/RNA Molecule: Synthetic oligonucleotide
gaauauccaguuccuguggtt

SEQ ID NO: 1869 - DNA, 21 bp, Artificial Sequence
  Description of Artificial Sequence: Synthetic oligonucleotide
  Description of Combined DNA/RNA Molecule: Synthetic oligonucleotide
cacaggaacuggauauucutt

SEQ ID NO: 1870 - DNA, 21 bp, Artificial Sequence
  Description of Artificial Sequence: Synthetic oligonucleotide
  Description of Combined DNA/RNA Molecule: Synthetic oligonucleotide
agaauauccaguuccugugtt

SEQ ID NO: 1871 - DNA, 21 bp, Artificial Sequence
  Description of Artificial Sequence: Synthetic oligonucleotide
  Description of Combined DNA/RNA Molecule: Synthetic oligonucleotide
acuggauauucugaaaacctt

SEQ ID NO: 1872 - DNA, 21 bp, Artificial Sequence
  Description of Artificial Sequence: Synthetic oligonucleotide
  Description of Combined DNA/RNA Molecule: Synthetic oligonucleotide
gguuuucagaauauccagutt

SEQ ID NO: 1873 - DNA, 21 bp, Artificial Sequence
  Description of Artificial Sequence: Synthetic oligonucleotide
  Description of Combined DNA/RNA Molecule: Synthetic oligonucleotide
auucugaaaaccguaaaggtt

SEQ ID NO: 1874 - DNA, 21 bp, Artificial Sequence
  Description of Artificial Sequence: Synthetic oligonucleotide
  Description of Combined DNA/RNA Molecule: Synthetic oligonucleotide
ccuuuacgguuuucagaautt

SEQ ID NO: 1875 - DNA, 21 bp, Artificial Sequence
  Description of Artificial Sequence: Synthetic oligonucleotide
  Description of Combined DNA/RNA Molecule: Synthetic oligonucleotide
uucugaaaaccguaaaggatt

SEQ ID NO: 1876 - DNA, 21 bp, Artificial Sequence
  Description of Artificial Sequence: Synthetic oligonucleotide
  Description of Combined DNA/RNA Molecule: Synthetic oligonucleotide
uccuuuacgguuuucagaatt

SEQ ID NO: 1877 - DNA, 21 bp, Artificial Sequence
  Description of Artificial Sequence: Synthetic oligonucleotide
  Description of Combined DNA/RNA Molecule: Synthetic oligonucleotide
ugaaaaccguaaaggaaautt

SEQ ID NO: 1878 - DNA, 21 bp, Artificial Sequence
  Description of Artificial Sequence: Synthetic oligonucleotide
  Description of Combined DNA/RNA Molecule: Synthetic oligonucleotide
auuuccuuuacgguuuucatt

SEQ ID NO: 1879 - DNA, 21 bp, Artificial Sequence
  Description of Artificial Sequence: Synthetic oligonucleotide
  Description of Combined DNA/RNA Molecule: Synthetic oligonucleotide
gaaaaccguaaaggaaauctt

SEQ ID NO: 1880 - DNA, 21 bp, Artificial Sequence
  Description of Artificial Sequence: Synthetic oligonucleotide
  Description of Combined DNA/RNA Molecule: Synthetic oligonucleotide
gauuuccuuuacgguuuuctt

SEQ ID NO: 1881 - DNA, 21 bp, Artificial Sequence
  Description of Artificial Sequence: Synthetic oligonucleotide
  Description of Combined DNA/RNA Molecule: Synthetic oligonucleotide
aguuugccaaggcacgagutt

SEQ ID NO: 1882 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1883 - DNA, 22 bp, Artificial Sequence
  Description of Artificial Sequence: Synthetic oligonucleotide
  Description of Combined DNA/RNA Molecule: Synthetic oligonucleotide
aaguuugccaaggcacgagutt

SEQ ID NO: 1884 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1885 - DNA, 23 bp, Artificial Sequence
  Description of Artificial Sequence: Synthetic oligonucleotide
  Description of Combined DNA/RNA Molecule: Synthetic oligonucleotide
  modified_base (1)..(1): Inverted abasic nucleotide
  modified_base (23)..(23): Inverted abasic nucleotide
naguuugccaaggcacgaguttn

SEQ ID NO: 1886 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1887 - DNA, 23 bp, Artificial Sequence
  Description of Artificial Sequence: Synthetic oligonucleotide
  Description of Combined DNA/RNA Molecule: Synthetic oligonucleotide
  modified_base (1)..(1): Inverted abasic nucleotide
  modified_base (23)..(23): Inverted abasic nucleotide
naguuugccaaggcacgaguttn

SEQ ID NO: 1888 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1889 - DNA, 23 bp, Artificial Sequence
  Description of Artificial Sequence: Synthetic oligonucleotide
  Description of Combined DNA/RNA Molecule: Synthetic oligonucleotide
  modified_base (1)..(1): Inverted abasic nucleotide
  modified_base (23)..(23): Inverted abasic nucleotide
naguuugccaaggcacgaguttn

SEQ ID NO: 1890 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1891 - DNA, 23 bp, Artificial Sequence
  Description of Artificial Sequence: Synthetic oligonucleotide
  Description of Combined DNA/RNA Molecule: Synthetic oligonucleotide
  modified_base (1)..(1): Inverted abasic nucleotide
  modified_base (23)..(23): Inverted abasic nucleotide
naguuugccaaggcacgaguttn

SEQ ID NO: 1892 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1893 - protein, 4 aa, Artificial Sequence
  Description of Artificial Sequence: Synthetic peptide
EAFQ

What is claimed is:

1. A polynucleic acid molecule that mediates RNA interference against EGFR, comprising a sense strand and an antisense strand that hybridizes to an EGFR target sequence selected from SEQ ID NOs: 1-376, wherein:
the polynucleic acid molecule comprises the sense strand comprising i) two consecutive 2'-O-methyl modified nucleotides at the 5'-end and ii) eight consecutive repeats of A-B, wherein A is a 2'-fluoro modified nucleotide and B is a 2'-O-Me modified nucleotide, and iii) at least one phosphorothioate internucleotide linkage;
the polynucleic acid molecule comprises from about 90% to about 100% modification; and
the polynucleic acid molecule is from about 10 to about 50 nucleotides in length.

2. The polynucleic acid molecule of claim 1, wherein the antisense strand comprises two consecutive 2'-fluoro modified nucleotides at the 5'-end.

3. The polynucleic acid molecule of claim 1, wherein the sense strand comprises locked nucleic acid (LNA) or ethylene nucleic acid (ENA).

4. The polynucleic acid molecule of claim 1, wherein the sense strand further comprises at least one inverted abasic moiety.

5. The polynucleic acid molecule of claim 1, wherein the polynucleic acid molecule further comprises a phosphorodithioate linkage on the antisense strand.

6. The polynucleic acid molecule of claim 1, wherein the polynucleic acid molecule is from about 10 to about 30 nucleotides in length.

7. The polynucleic acid molecule of claim 1, wherein the polynucleic acid molecule is at least 16, 17, 18, 19, 20, 21, 22, 23, 24, or 25 nucleotides in length.

8. The polynucleic acid molecule of claim 1, wherein the polynucleic acid molecule comprises about 100% modification.

9. The polynucleic acid molecule of claim 1, wherein the sense strand and the antisense strand are RNA molecules.

10. The polynucleic acid molecule of claim 1, wherein the sense strand comprises a sequence having at least 80%, 85%, 90%, 95%, 96%, 97%, 98%, 99%, or 100% sequence identity to a sequence selected from SEQ ID NOs: 377-1892.

11. The polynucleic acid molecule of claim 1, wherein the antisense strand comprises a sequence having at least 80%, 85%, 90%, 95%, 96%, 97%, 98%, 99%, or 100% sequence identity to a sequence selected from SEQ ID NOs: 377-1892.

12. A pharmaceutical composition comprising:
 a) the polynucleic acid molecule of claim 1; and
 b) a pharmaceutically acceptable excipient.

13. The pharmaceutical composition of claim 12, wherein the pharmaceutical composition is formulated as a nanoparticle formulation.

14. The pharmaceutical composition of claim 12, wherein the pharmaceutical composition is formulated for parenteral, oral, intranasal, buccal, rectal, or transdermal administration.

15. A method of treating a disease or disorder in a patient in need thereof, comprising administering to the patient a composition comprising the polynucleic acid molecule of claim 1.

16. The method of claim 15, wherein the disease or disorder is a cancer.

17. The method of claim 16, wherein the cancer comprises a EGFR-associated cancer.

18. The method of claim 16, wherein the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, or thyroid cancer.

19. The method of claim 16, wherein the cancer comprises acute myeloid leukemia, CLL, DLBCL, or multiple myeloma.

20. A method of inhibiting the expression of EGFR gene in a primary cell of a patient, comprising administering the polynucleic acid molecule of claim 1 to the primary cell.

21. The method of claim 20, wherein the method is an in vivo method.

22. The method of claim 20, wherein the patient is a human.

23. The polynucleic acid molecule of claim 1, wherein the polynucleic acid molecule comprises two inverted abasic moieties.

24. The polynucleic acid molecule of claim 2, wherein the antisense strand comprises eight consecutive repeats of B-A.

25. The polynucleic acid molecule of claim 24, wherein the eight repeats of B-A are adjacent to the two consecutive 2'-fluoro modified nucleotides.

26. The polynucleic acid molecule of claim 1, wherein the sense strand comprises 5'-B-B-A-B-A-B-A-B-A-B-A-B-A-B-A-B-A-B-A-dTdT-3'.

27. The polynucleic acid molecule of claim 1, wherein the polynucleic acid molecule has improved stability relative to an equivalent polynucleic acid molecule without the modification of at least three phosphorothioate internucleotide linkages.

28. The polynucleic acid molecule of claim 1, wherein the sense strand comprises a sequence selected from SEQ ID NOs: 377-1892.

29. The polynucleic acid molecule of claim 1, wherein the antisense strand comprises a sequence selected from SEQ ID NOs: 377-1892.

30. The polynucleic acid molecule of claim 1, wherein the polynucleic acid molecule comprises about 100% modification, and wherein at least 45% of the modification is 2'-O-methyl.

* * * * *